United States Patent 10,718,023 (GENETIC POLYMORPHISMS ASSOCIATED WITH LIVER FIBROSIS, METHODS OF DETECTION AND USES THEREOF) - sequence listing, part 5

SEQ ID NO: 27560 - DNA, 201 bp, Homo sapiens
tcattgtttctgctaattcccactcccccaaactattcacacagcaaccacagtgattttcttaaaacacaagtcaagtcgcgtcatttcctctgctgaaraacttccaaagccttcccatctcattgaaagtaaaatccaaattccacactataacccacataaaactttatctcatctagtctagggctacctccttga

SEQ ID NO: 27561 - DNA, 201 bp, Homo sapiens
tgcatagtattccatggtgtatatgtgccacattttcttaatccagtctatcgttgttggacatttaacaaacagaatcaagcagccatgatggggtgtcmcttctgagattcagttacaaaaaagactgtgccttccatcttggacacacactttcattctctcacttgcttgctcactctgagggaggccaactgccat

SEQ ID NO: 27562 - DNA, 201 bp, Homo sapiens
tgacaagggctgagggaggcctccagccagtagccaacaaggaactgagttctctcagtccaacaagctgcaatgaactgaatcttgccaactgttccagytggcacactgaatgcatcctcttgagagaccttgaagtggagacaccagctaagccatacttaggtttctgacccacagaaactgtgagataataaatgt

SEQ ID NO: 27563 - DNA, 201 bp, Homo sapiens
agcattggtatggacatatacaattgtagaattttttcagactgggatgtttatttgcacaatacttggcaaaggagaggagcatagcacctttaaattargaggcaaaacttcatttcagcagctattttaatcgtgagcctcacccagcccatctccatttcactcaggatccttcaacaacactccacttatgtatga

SEQ ID NO: 27564 - DNA, 201 bp, Homo sapiens
aatatttactttatacagttagtaataagattaaattagcagctaacatgtaaaacaccagtagcaaacacacctaggtaatcaatacataattgttcatkaaacctagccctatcagctgtcactatgaacaaaaatatcccacttggcctgttctctctcagctagtttgttcacaagccccaggtgatccttagtatg

SEQ ID NO: 27565 - DNA, 201 bp, Homo sapiens
tactaaaaatacaaacattagccaggcgtggtggcgggtgcctgtaatcccatctattggggaggctgaagagcaagaatcgcttgaacccaggaggcggrggttgcagtgagccaagatcacaccactgcactccagcctgagtgatagagcgagactcagtctcaaaaacaaacaaacaaacaaacaaaaagttgatgg

SEQ ID NO: 27566 - DNA, 201 bp, Homo sapiens
ccatctattggggaggctgaagagcaagaatcgcttgaacccaggaggcgggggttgcagtgagccaagatcacaccactgcactccagcctgagtgatasagcgagactcagtctcaaaaacaaacaaacaaacaaacaaaaagttgatggcccagtaatcatctaggattgtggaaaggagcttccggaagggtggagc

SEQ ID NO: 27567 - DNA, 201 bp, Homo sapiens
tgaaactgagaagagatttctctgtgcacatcacaatcctgtttcactggtcctgcaaatacacagccttgagaaacctaaacagggaatcttctttaacsccgtaccactttgctgcacagctaactagatggaggaaggaagagtaaattaacaatcagtacccacctcctctgtgccaaaccctgtgctcggcccttt

SEQ ID NO: 27568 - DNA, 201 bp, Homo sapiens
ctctgcttcatatctgcatttagagaaccaggttcctcccagatcattactctgaaacccctatgatcttgctcttgtctccacagtcaaggttgggttgytctgagttccaccttgtaggaaggggaaagaacatggaggagtcttatgtcccagagctgaatatgacacacactttgctcacattccactggcagggaa

SEQ ID NO: 27569 - DNA, 201 bp, Homo sapiens
ctcccagatcattactctgaaacccctatgatcttgctcttgtctccacagtcaaggttgggttgctctgagttccaccttgtaggaaggggaaagaacayggaggagtcttatgtcccagagctgaatatgacacacactttgctcacattccactggcagggaattagttccttgatcatgtctaacagcaagggagac

SEQ ID NO: 27570 - DNA, 201 bp, Homo sapiens
taagaaaacttgccttacataaccagtaagtgacagagcaaggatttgaacctcaacttcaatactcacttccacatgctccataaggtagacttctattkctcctccatgtatgtatttatccttcttcccaattccagctcttgaaatgacctcatccaccattagcaacatatatgccataagttactatctactctg

SEQ ID NO: 27571 - DNA, 201 bp, Homo sapiens
tgtaaagatgaagatggaaagctactaacaatcaataataaaagaggctgaaatggaaaattaaggacatagaacagactgggtgaatttaggtcatttcygatgtaatgtgtccagcatttctcttaaacaatttttatttactaatttgaattagcagtacatttccaaaatgaacaaaggtttaaaaggaaacactct

SEQ ID NO: 27572 - DNA, 201 bp, Homo sapiens
tgtatgtgactaaacctataggataaattcctagcactggctttaataagtcaaagcatatagatgttcataagaatatttccaaataacccttcataagrtagtaccaatttattttcccaccagtcatatatgagagcacctgtctcttcacattcttgccaacacagtgtgttgttaattttttgtcattgccaatct

SEQ ID NO: 27573 - DNA, 201 bp, Homo sapiens
aggagttctttacttacaaagaaaattagctagcttttgtctattaaatgagttccaaatagtttccgtttttataattgtctagtgactttttatgatgrgttttgcattgcagaaaagcattccttttattcactctctgaagcatctcactaaattgggagatgctcataaaataagccaaactttcctagattgcag

SEQ ID NO: 27574 - DNA, 201 bp, Homo sapiens
ctccttggcaagggccctgacagcccagctggcccacagccaccatcctgttcctctcagcaagcagccagagtcctgtttcaacacggatagtcctcccyaccccgcttcctctgctgtccccctcttcctgaccaactgaacatttccattatccagcgttcagcttttcccctgctgcattcccctccctccactagg

SEQ ID NO: 27575 - DNA, 201 bp, Homo sapiens
catctctacaaaaaataaattagcgtgagccgagatcgcgccactgcactccagcctgggcgacagagcgagactccgtctcaaaaaaaaaaaaaaataawaaaaaataaattagcacacctgtaatcccagcactttgggaggacaaggtgggtggatcacttgaggttagaagtttgagaccagcctggccaacatggt

SEQ ID NO: 27576 - DNA, 201 bp, Homo sapiens
caaaaaataaattagcgtgagccgagatcgcgccactgcactccagcctgggcgacagagcgagactccgtctcaaaaaaaaaaaaaaataaaaaaaaatraattagcacacctgtaatcccagcactttgggaggacaaggtgggtggatcacttgaggttagaagtttgagaccagcctggccaacatggtgaaacccc

SEQ ID NO: 27577 - DNA, 201 bp, Homo sapiens
tcaaggtgttaacttgtttttctagacttgatgtcctgttcaaataaaggacaggtttgattcagatagaatcaatcattgtcctgaccggaagcagatgscatactcaaagggtctaactgaaggatgtgaaatgaagggactatttacagatgtgtgggcaggcatagggaacaagcgatggtgaggcactgtgggact

SEQ ID NO: 27578 - DNA, 201 bp, Homo sapiens
caaatctaactagaagccaaaaagcaaaggagcctgggcaatggagtctgcagggggggagtctccaggggtgcagggcaggatggtgaaaggtgctgaayggatttctaagggcaaatggagaatgatgagcacgcaactttgacatttttggctagaatgctttataggtcatgctgtgaacttcagattgcatcacat

SEQ ID NO: 27579 - DNA, 201 bp, Homo sapiens
tccctactgagatgtaaaggtgtgttttcactttgcaatcagcaagtgatccagcaggagacacttggcaccagggggattcacggttttgctccaataayttttcacgtaattgtttcagcatccatggatgattcttccctgaatcggtcatttcactgggagttgcaaaatgttgatttttctgagtttttcttccca

SEQ ID NO: 27580 - DNA, 201 bp, Homo sapiens
cttccctgaatcggtcatttcactgggagttgcaaaatgttgatttttctgagtttttcttcccatatttggatatggaatgaaaatcatgtgaaattttmtacattaaaaatagttgaggctgggtgccggtggctcatgcctgtaatcacagcactttgggaggccaacgcgggcagatcacgaggtcaagagatagag

SEQ ID NO: 27581 - DNA, 201 bp, Homo sapiens
cagtgagagctccttcaagctaaccccttgataggcccctgttagtcttggaggactttccttctggaactctggtacgtctaggcttacctggtttaagytatatttccctgccccagacctccaaagaaccttggctaattttagtagaaaatgatatttagaggctgggcatggcggatcacacctattatcccagca

SEQ ID NO: 27582 - DNA, 201 bp, Homo sapiens
tggcggatcacacctattatcccagcattttcgtgggccaaagcgagagggtctcctgagcccaggagtttgagaccagcaacatggtgaaaccccgtgtytccaaaaaccacaaaagtattagctgggcatgttggcacatgcctgtagtcccagctactccgggggctgaggcgggaggatcacctgagcccaggaagt

SEQ ID NO: 27583 - DNA, 201 bp, Homo sapiens
aggtcccaatgtagataaaggacctgaaatggaaagtttatatatgaacattactcatctttaggcctctctttaggccatactttctttggtgcataacytttctactgtctctgactgtcaaaatcatattcatcctcaagagctttccccgacccccaggacccccagcatagtgtagccttgccctacctgcagtgc

SEQ ID NO: 27584 - DNA, 201 bp, Homo sapiens
ggagtgaagtggctcaattttggctaactgcaacctccgcctcccgggttcaagtgattctcctgcctcagcctcctgagtagctgggattacaggcatgygccaccacgcctggctaatttttgtatttttttaagtagagatggggtttcaccatgttggtcaggctggtctcgaactactgacctcgtgatccgccca

SEQ ID NO: 27585 - DNA, 201 bp, Homo sapiens
tcttgattaaaagaaactttcccattgcctgtccatctttcaccctagttacttacttttgaaacctcaggcttatgttatttctaattattatagttgcytagtaatacttctattttaaggctgcttctaattttcaaataacaattttaaatacctttaaatagattatactatttttttaatgtcattaggttgaga

SEQ ID NO: 27586 - DNA, 201 bp, Homo sapiens
gattagaataatttttggctcctaaatcttcctaatagctgatagattttctaaagaacaaatttagctttattggatacctttagattcttaacacaagyactacagttgaggaaaaggaaaaaggaaaaatagacatattgaaagaatattagacataggtttgaatcccaactctgctacttacaaactatataatgt

SEQ ID NO: 27587 - DNA, 201 bp, Homo sapiens
agaataatttttggctcctaaatcttcctaatagctgatagattttctaaagaacaaatttagctttattggatacctttagattcttaacacaagtactwcagttgaggaaaaggaaaaaggaaaaatagacatattgaaagaatattagacataggtttgaatcccaactctgctacttacaaactatataatgtttgg

SEQ ID NO: 27588 - DNA, 201 bp, Homo sapiens
tttgtggtattgttacaaagttaaattagataacctagaagatagcccctggcataccacctggcatattgtagggaatgaataaatgtttattgagatgmcccttactatatagatttggtggaaagtggtgtttggatatcccaggtcagattgtccattgtaattaagggttttttcgtcagcatcagaaattacaat

SEQ ID NO: 27589 - DNA, 201 bp, Homo sapiens
tccaaacaagtcattggcttaaagggattattgaagaatggcatgcgagacttgaatgggtcggggaaagagaaaagctgaagtcctaagttgtaaaccakaaattgtcccagaaagctgtatttcgaaccaagagtaatgacctgtaggagagttattacatcaatttaatgggtcatgacccgtttatttttttaatta

SEQ ID NO: 27590 - DNA, 201 bp, Homo sapiens
ggctgggtgcagtggctcatcccttgggaggccaaggcaggcagattgctccagcccagaagtttgagaccagcctgggcaacatggcgaaaccacatctytacaaaaaaatgcaaaaatttgccgggcggctgtggtggcgcatgcctgtagtcccagccactttcgggctgaggtgggaggatctcttgaccccgggag

SEQ ID NO: 27591 - DNA, 201 bp, Homo sapiens
tgagccgagattcacaccactgcattccagcctgtctcgaaaaaaaaaaaaaaaaaagaaaggaagagagagagagaagaaaaaaagaaagaaagaaagaragaaaggaagaaagaaagaaagaaaaagaaagaaagaaagaaagaaagaaagaagaaaaagaaagaaagaaagaaagaaagaaagaaagaaagaaagaaa

SEQ ID NO: 27592 - DNA, 201 bp, Homo sapiens
gaaagaaaaagaaagaaagaaagaaagaaagaaagaagaaaaagaaagaaagaaagaaagaaagaaagaaagaaagaaagaaagaaagaaagaaagaaagrgaaagaaaggaaggaaaagaaattaatcctctacatatggagcttttttaaaatgttaagtatactagaaaagaaagagcagaatccagaaataaaagac

SEQ ID NO: 27593 - DNA, 201 bp, Homo sapiens
tactggaaatccaggtttttataatgaaaaacattttaaaacactgggtaagccaaatgaaacatgtctgaaggcctaaacacactcacactacaccaagygtgaatagctgctgtgtgtaggtggtgatacttggggtcatttatattttcatttttacatttcactgcatgtttcagaattttaacagtgaacatcatt

SEQ ID NO: 27594 - DNA, 201 bp, Homo sapiens
taaacaggtagacatttgagttttctctttttagtttacaagcaattctttacccatcatttcagacaccaggctgttctttctgtgggtggtggtggtgrtggtggtgacaaagggtgataggcaggtggggtgccctggccccttgttgttttatcctgcattaagatcaggataaaacaacaaatgttacagaaattt

SEQ ID NO: 27595 - DNA, 201 bp, Homo sapiens
acaggtagacatttgagttttctctttttagtttacaagcaattctttacccatcatttcagacaccaggctgttctttctgtgggtggtggtggtgatgrtggtgacaaagggtgataggcaggtggggtgccctggccccttgttgttttatcctgcattaagatcaggataaaacaacaaatgttacagaaattttct

SEQ ID NO: 27596 - DNA, 201 bp, Homo sapiens
tgagatgaggcctcactctgtcgcacacactggagtgcactggggtgatctcagctcactgcaacctccgcctccctggttcaagtgattctcctacctcrgcttctcgagtagctgggattacagatgtgtgtaccaccatgcccggctaatttttgtatttttagtagagacagggtttcgtcacattagccaggctgg

SEQ ID NO: 27597 - DNA, 201 bp, Homo sapiens
aggcctcactctgtcgcacacactggagtgcactggggtgatctcagctcactgcaacctccgcctccctggttcaagtgattctcctacctcagcttctygagtagctgggattacagatgtgtgtaccaccatgcccggctaatttttgtatttttagtagagacagggtttcgtcacattagccaggctggtcacaaa

SEQ ID NO: 27598 - DNA, 201 bp, Homo sapiens
gcccggcctatccatagctctttgaaccattcacaacaacctatgaaacctcagtttcatatatgaatacatatatcttcatgaagaaggatgatttaacrttatataattttcccaccagaagaactacactatactcacctcaggctattaaaaaattttcattactttttttgtgttttactgaatatttttaaatcc

SEQ ID NO: 27599 - DNA, 201 bp, Homo sapiens
tattgctgaggcctcctttccttgctaataagattaacacctgttctttctggttcctagaacaaagagaagaataaggaagaaaatcatgctccatcttygtaagtataaccagtgctagcatagaggagaagaggcatgaacgataaagctactttaagaatgcaaaatagcccaggctcagtggctcacacctgtaat

SEQ ID NO: 27600 - DNA, 201 bp, Homo sapiens
ctagattgatggtcagttactcaagaaacaattatccagtttgtggatttcctctgttccttctgcttattgtctgcttggcatttttcactattcattaycatctcctgcagagggtattagagaaaaagaggggaggtgagattcaaaataaaattccaataaattatcatcaagcacctactttaagccagatgctga

SEQ ID NO: 27601 - DNA, 201 bp, Homo sapiens
tgagtcagcatttactaccatgggatataactcagaaactcatatatctaactttatttgagaaatgggaaaatccagtaacataagacctgtattccacrtagtggaacaattggctgaaactaaatagcaaatattacccttttgtccaatatctacctgttgttgtcagcctccaagctggtccccactgatcctcat

SEQ ID NO: 27602 - DNA, 201 bp, Homo sapiens
agaagcatgaaatatcattacctttacctttcatagccccagtttaggataaactctgggtcagcagttacatgactgacctgaaatgatttcactctgcrgctggcagcgccagactcaggagtgacaaactgaagtaaatgactgtgtgagcagcttctggtgagaccaaatagaagaactgcagcagataacttactc

SEQ ID NO: 27603 - DNA, 201 bp, Homo sapiens
aacttactctttttcattgtttctgattagatcttttcacattttgcttttgtttttgtttttttcttggaaaagacaagggtgtctcatggaggctttakggaaatggctgaattttaaggaaatcgaattggctcccatgattatctcaaaggagctgtggtcgtaaaagttaattaaattagattcatttgcatattc

SEQ ID NO: 27604 - DNA, 201 bp, Homo sapiens
tatctcaaaggagctgtggtcgtaaaagttaattaaattagattcatttgcatattcaagaccattcccttccttcactttaaaggcagagaaagaaaatktgtcccagcctcctcactgggattatgacacacaacatgtccagatcactctgtttgtatgctggaacttagtcggactagcaggctattttttaaatcc

SEQ ID NO: 27605 - DNA, 201 bp, Homo sapiens
ttcagtggcattaattatacaatttcaatattgtaagccattaccactatctatttctgaaaatgtttcattccaatgcactttttatttttttttttgaracaaagtctcactctgtctcccaggctggagtgcagtggcacgatctcagctcactgcaacctccacctcccagattcaagcaattctcctgcctcaacc

SEQ ID NO: 27606 - DNA, 201 bp, Homo sapiens
tgtctcccaggctggagtgcagtggcacgatctcagctcactgcaacctccacctcccagattcaagcaattctcctgcctcaacctcccaagtagctgarattacaggtgtgttccaccatacctggttaatttttgtatttttagtagagacagggattcacaatgttggccatgctggtctcaaactcctaacctcaa

SEQ ID NO: 27607 - DNA, 201 bp, Homo sapiens
ttagtagagacagggattcacaatgttggccatgctggtctcaaactcctaacctcaagtgatctgccagcctcagtctcccaaagtgctgggattacaascgtgagccaccgtgcccggcccaatgcacttttaaaataatctgggcaagttctacgaggatcctcacaactcatgaacctggctttctatcatgattcc

SEQ ID NO: 27608 - DNA, 201 bp, Homo sapiens
caagactgggaagaaaaagaggtataattggacttacagttccacgtggctggggaggccttagaatcatggtgggaggcaaaaggtccttcttacacggyggcagcaagagaaactgaggaagaagcaaaagcagaaacccctgataaacccaccagatcttgtgagacttattcaatatcacggaatagcatgggaaag

SEQ ID NO: 27609 - DNA, 201 bp, Homo sapiens
agttgtggaggttaaaattttttgaaagctactttactcgaccaaagttgaagccttggctttattttctgcattgagctccctctgtaaaacagagaaaraaaatgtctgtgtgtgtgtatgtacattcatgtgcatataactatgtgcatgtatacatgtaattatcctaaaagaatttcagaaaaagcagccaggtgc

SEQ ID NO: 27610 - DNA, 201 bp, Homo sapiens
atgttccaatcacttgaatccaaagggaccgcttatccccctttgctgggacaacctccatgtatgcctgttgttgtaccttattattaatagtgcagccrggcacggtggctcatgcctgtaatcccagtactttgggaggccgaggcaggtggatcacctgaagtcaggagttcgagaccagcctgaccaacatggtga

SEQ ID NO: 27611 - DNA, 201 bp, Homo sapiens
agagctcctaggtcaagtagtgataagggctacaaagagaaaaccagacagggtaaggggaacagggagtgcccaggtggagaagggctgctactttaaamcggtggctaagggtcactaataagatgacattcaagcagacacttaaaggagaaaagaggtaaaggaattatctaggcagatatttatttatttatttat

SEQ ID NO: 27612 - DNA, 201 bp, Homo sapiens
cttgcacctgtaatcctagcactttgggaggccgaggctgatgggttgcttgaggccaggagttcaagaccagcctggccaacacagcaagaccccatttytaaaaaaaaaaaaaaaatttttttaattagctgggcatggtggcatgcatccatagtcccagctactggagaggctgagacaggagggttgcttgtgccc

SEQ ID NO: 27613 - DNA, 201 bp, Homo sapiens
cagccacagtcctgtccctggccttcatcaccttacccctgaattattgcactagcacccccactccctcactggtgctcacgggactgcccgctgccccygctctcctgttctcaccttcatcacatcattcccctgctcaggaaatatgactgtgccttgcccatcgtccccaagtccaaattcctctccctggctctc

SEQ ID NO: 27614 - DNA, 201 bp, Homo sapiens
ccgaggctgatgggttgcttgaggccaggagttcaagaccagcctggccaacacagcaagaccccatttctaaaaaaaaaaaaaaaatttttttaattagstgggcatggtggcatgcatccatagtcccagctactggagaggctgagacaggagggttgcttgtgcccaggagtttgaaggtgtggtgagctttgatca

SEQ ID NO: 27615 - DNA, 201 bp, Homo sapiens
cattaaattctaagttgtgtttacagcaaaactctcattactgccccccaagcttttgctaagcattttgtcttcttcctgtctctaccatctctaccatrtcttctacctatctctaccatgccaaatcccacccagctctcaaggtgtaattcaacttcctgattttccacaaaacttctctaaatacatgagacctca

SEQ ID NO: 27616 - DNA, 201 bp, Homo sapiens
tgggtggattgcttgaggtcaggagttcaagaccagcctgaccaacatggtgaaaccccatctttattaaaaatacaaaaattagcccagcatggtggcargcgcctgtaatcccagctactcgggaggctaaggcaggagaatggcttgaagccaggaggtggaggttgcagtgagcggagatcacaccattgcactcca

SEQ ID NO: 27617 - DNA, 201 bp, Homo sapiens
gggtggattgcttgaggtcaggagttcaagaccagcctgaccaacatggtgaaaccccatctttattaaaaatacaaaaattagcccagcatggtggcagrcgcctgtaatcccagctactcgggaggctaaggcaggagaatggcttgaagccaggaggtggaggttgcagtgagcggagatcacaccattgcactccag

SEQ ID NO: 27618 - DNA, 201 bp, Homo sapiens
caccattgcactccagcctgggcgaaagagcgagactccgtctcaaaaaaataataattttatatatatatgtataatgtgataaatggtctaatagttgstctacaatacatacacctcggattcacattttgcagacttcacgaattcatagaattttacaaattgtaaaggattccaggaatcatttgacacaatccc

SEQ ID NO: 27619 - DNA, 201 bp, Homo sapiens
taatgtttttctatatgttatgatgttttatttatttatttatttatttgagacagagtattgctctgtcacccaggctggggtgcagtggcacaatctargctcactgcaacctctgcctcctgggttcaagcgattctcctgcctcagcctcccaggtaactaggattacaggcactcggcaccacacccagctaattt

SEQ ID NO: 27620 - DNA, 201 bp, Homo sapiens
atttatttatttatttgagacagagtattgctctgtcacccaggctggggtgcagtggcacaatctaggctcactgcaacctctgcctcctgggttcaagygattctcctgcctcagcctcccaggtaactaggattacaggcactcggcaccacacccagctaatttttgtatttttagtagagatggggttttaccgtg

SEQ ID NO: 27621 - DNA, 201 bp, Homo sapiens
gtccagagccatacctcctctaccaggaggcaatattcctctgccttaatcatcccaggctgcataccaggaaactaaagactactcctatagcccaaagyttacaggaattattcaaactagccaattccagtttcctctgccctgtcttccccatgaaaaccccagtaaagatgcctcctgtttccagaccctctgggg

SEQ ID NO: 27622 - DNA, 201 bp, Homo sapiens
cccagcccttttgtaaataaaacctttatacaactaaagcagcactgacttcaatgggaagttatgatatcagtgctacagtgaaatggattgctacaaamagaataagagaggaatagattggataatcaacacatatagcaactcaaaaggatcgttttagtgatttcttttaatcttctctactactaagtatttcac

SEQ ID NO: 27623 - DNA, 201 bp, Homo sapiens
tcagtcaagccatgcttctgacctgcaaagcctccatatcagacccaaaaattcacaagtaagtaagtaagagcttcaaagaacttctctccctcagccarggttaactataaaatgacccaaatatgcttaacagaccaaaaaaaaaattggctaatgaatggaactatttacaactgtatttttgcaaatagaatcaaa

SEQ ID NO: 27624 - DNA, 201 bp, Homo sapiens
gtgagttgatggattttatctaacccatctgcaacgattattcaaatgtaagctttaaagttttataacatttagctaaagaagaatcaaaactcttttcwttgccccgtgtaagcacaaacactctcctcgccctgccaatttgccagtctactgtctcatgctatggtctcatacaaggataaaaaaaatcacaccaca

SEQ ID NO: 27625 - DNA, 201 bp, Homo sapiens
ctgaattatttataagctaatgctctgctttcaatgtttctatcagctgcaaaatttaattaagaagcaaagaatgggcttatagagatcatgaccctacrtatttcttactcatatttcaaattataatcatgtcatgatgaagtttgatcctcgtggagtgtaacaaaataatatatttgaactttttattattaccag

SEQ ID NO: 27626 - DNA, 201 bp, Homo sapiens
gctcatgaggaagataaggactaggtcacaagaggtctcataggtcatgttgaggtgactgaatttcctccttatagaccaaatttcctaagacagtttayagaaatttctagtgttcacagaggcatttcatgaaaaattccttggtattcctcaacataatagcttcactgtgacttctttttgaagcatcctaaattt

SEQ ID NO: 27627 - DNA, 201 bp, Homo sapiens
caagataaattacttaaattctcacttaaaaagtgaatctgcagtagagctactaccattatccaaatgtcacaaatatacctaaataggttaatttttartatatattgtagtgaatcatttaacaaaactaatttttatcttttttttctatctcagcttcttaaaagcaaaagatacatcttcatctttgtgccctga

SEQ ID NO: 27628 - DNA, 201 bp, Homo sapiens
tcttacataggtgagagtgaaggacatgataaggatgctcaaggagaagagagaatgtgcctgcgatctcagtggcatttgtgagctaccataccagctgrgtctgcctatttttgacacacttttgtgtggacaataaattaattgattaatcaaagagcttgtttgcttaagatatggtttgtcaggattttggttcct

SEQ ID NO: 27629 - DNA, 201 bp, Homo sapiens
catactactttcatttcattcctcaaagccaccaaatgtagtctcacctcagggcctctgtacttgctgttcactctgcttcagttgcttttccacctggytcctcctcatcattcaggtttcagctccaatgtcacctccttagagagaccttctctgaccaccccatttcacctgtgtttcatgatctcaataccctat

SEQ ID NO: 27630 - DNA, 201 bp, Homo sapiens
tactactttcatttcattcctcaaagccaccaaatgtagtctcacctcagggcctctgtacttgctgttcactctgcttcagttgcttttccacctggttyctcctcatcattcaggtttcagctccaatgtcacctccttagagagaccttctctgaccaccccatttcacctgtgtttcatgatctcaataccctatgt

SEQ ID NO: 27631 - DNA, 201 bp, Homo sapiens
actactttcatttcattcctcaaagccaccaaatgtagtctcacctcagggcctctgtacttgctgttcactctgcttcagttgcttttccacctggttcytcctcatcattcaggtttcagctccaatgtcacctccttagagagaccttctctgaccaccccatttcacctgtgtttcatgatctcaataccctatgtt

SEQ ID NO: 27632 - DNA, 201 bp, Homo sapiens
attaaaagcttcatgagtacagggactgtgtatatcttattcaccactccattcccatatctagaaaaatattagtacaaattaggcccttgataaatatygttcttaataaatagattaatttttctaaaaaaataaataaataaaaaataaaaaaaaaacacacagccttggatgcttggaaatctgccaacatgtatg

SEQ ID NO: 27633 - DNA, 201 bp, Homo sapiens
ggtcaggagtttgagaccagcctgaccaacatggtgaaaccctgtcttttctaaaaatataaaaattagccaggtgtggtgacgggcacctgtaatcccasctactcaggagactgaggcaggagaatcacttgaacccagaaggcgggggttgcagtgagccgagattgtgccactgcactccagcctgggtaacagagc

SEQ ID NO: 27634 - DNA, 201 bp, Homo sapiens
tataacccaaataaacaaaagatttttgagatcctcaattattaagagcataaaggaatcttgagaccaaaacctagtacaatagatagttataacagaartatgtaatagaaataaaaatgtatgatagaattatataacagaaatgcaaatcctacatttctaacagcatagatgaaatatttaatatcttcattccac

SEQ ID NO: 27635 - DNA, 201 bp, Homo sapiens
cgaaagagaatttaaatagttctgggggaagaataccccctgtctaaaatgaaagtctctctggcttagaggaggagtcagagtttaaggtaccctgtatyttgccttactccctggcagggccccaaggacacagcaagacctcagagagacaggccattggtgcaccaagaggcggaacattagcccaggtttcccaac

SEQ ID NO: 27636 - DNA, 201 bp, Homo sapiens
ttttgccttactccctggcagggccccaaggacacagcaagacctcagagagacaggccattggtgcaccaagaggcggaacattagcccaggtttcccarccacaacagttctcatactccagaggctagcacaaaggcaggagaggggagcctcttaaagaccacacagggagagacagtgacatcccagcagtaacct

SEQ ID NO: 27637 - DNA, 201 bp, Homo sapiens
gagatggagaccatcctggcgaacacggtgaaaccccatctctactaaaaatacaaaaaattagctggggtggtggcgggtgcctgtagtcccagctactygggaggctgaggcaggagaatggcgtgaacctgggaggcagaggttgcagtgagccgagatcacgccactgcactccagcctgggcgacagagcgagact

SEQ ID NO: 27638 - DNA, 201 bp, Homo sapiens
gttctcagcagactgcaaggctccacctcaggagaggagttcaggggcaggagccctgcccaagtgcacgattgcaatgaggcctgcagcctcagagacckggcaagtgatccaagaaggacccgaggcaaccatgcagggacctaaaaagcattaatgatataagcatgcattttgtcactcatgtatacatatatacgt

SEQ ID NO: 27639 - DNA, 201 bp, Homo sapiens
agaggcagtgtctgataaaggcccacttcctcatagacagctatcttctcactctaacttcacatgacagaaagattaaagggtatctctcaggccttttytttacaaaggcactattcccattcatgagagctccacattcatgacctaatcatctcctaaaggcctcacccccaatacggtcaccttggaagtgaagat

SEQ ID NO: 27640 - DNA, 201 bp, Homo sapiens
aaagaaaatgttacactttgttagtctaacaataatgttagaccacatatattcttaaaagaaatttggccccatttgctataaacatactgagtgattaycaggcaaagaaattactccagactttaaagctttttcattagctagaactagagttccagtcttgtctgtctgttatttttaagcaccccaagggtgcta

SEQ ID NO: 27641 - DNA, 201 bp, Homo sapiens
ccaaaatgatgtacatacagcccttagatgagaaaacgtttattgaagatggttgtctcaacttccaaaccttcagccttgtctctccgctcaaccttttyttaaaaataaaacttcatctgattttaatcgactattgccatcatcgtcgataaatgtttcttgacagaatactgctgattctgagaattgggaaagaaa

SEQ ID NO: 27642 - DNA, 201 bp, Homo sapiens
acctggtagtccttggctggaaaaagtttttgattttttgtctttataaagcaaagatgaaactaaactacctgccaaaaagacaaagagaaattgcattkaaataaaacttaaaacaagttgcagaatttgcatagtataatctcattttcagtttttaaattgtatgtgtgggtatatattattgaacactaactgcat

SEQ ID NO: 27643 - DNA, 201 bp, Homo sapiens
atctccacaaaaaaaaaaaaaaaaaaaaaaaaaaggcactggcctggtgcggtggctcacacctgtaatcccagcactttgggaggctgaagtggaagaaytgcttgaagccagaagttcaacaccagcctgggcaatacagtgggaccccatctcaataaaaaatataaaattttgaaaaagtcatttggagctaaattt

SEQ ID NO: 27644 - DNA, 201 bp, Homo sapiens
ctatctccacaaaaaaaaaaaaaaaaaaaaaaaaaaggcactggcctggtgcggtggctcacacctgtaatcccagcactttgggaggctgaagtggaagrattgcttgaagccagaagttcaacaccagcctgggcaatacagtgggaccccatctcaataaaaaatataaaattttgaaaaagtcatttggagctaaat

SEQ ID NO: 27645 - DNA, 201 bp, Homo sapiens
tatgtaactctaacaggaaattccctgtattgtcctatatttaaataaattaaatatatgagatgtgacaataaatacaagggcagatttttttaagcaarcacacatgtatagacacacaaatgagttattatccctttcaaagtattcacccattttaataatgcaaaccattttggaagctcctcttttaaaattgac

SEQ ID NO: 27646 - DNA, 201 bp, Homo sapiens
caaaccaggacaagctggtcaccctagtctagagatttaagaaaaagcaagtcttttgtcttattaaactttaagaggtgtcttagaattaaatgctttgmcgatgtaggatgctaatggccctttaatatctttaagcagcatattttctacaggtttgcagaaaacccaaagtataactgtgtgacaataaatacaata

SEQ ID NO: 27647 - DNA, 201 bp, Homo sapiens
aaggggcatttcacaacaggaatgaaattgcttctgccacaagcaggcaaacaaatttcttcacacaaggaaggagggagcatatttcagaaggccaaacrtaagtcttggcagtgaatttcaggaccccagggattgtgacaataggagggaggagtgatgcccctttttgaaggtctaggaagataggtagacagcaat

SEQ ID NO: 27648 - DNA, 201 bp, Homo sapiens
aaccctaaaattttccgtccttttaaaatttcctcttatatgggagccaagtaaaaccacttattaatttacctagtctgagttgagtattctattactcrcaacataaaaagacttaactctattgattagggtaaagctattctgccataagaaggaaactcaacaatgatggaatggtttaaaaatctaagttcattt

SEQ ID NO: 27649 - DNA, 201 bp, Homo sapiens
aagaaattttgctataaaatctgaacgctctctttgttcactgaaatgcacgcagacggctatgatctcctcagtttgcaaactgtttacaaggatgaagycttttctccaaattccttctcagagaacttttgttcataagggcaaccagcgccagagtgaagttgacttcatgaaagagcaaagggacaggagaaatca

SEQ ID NO: 27650 - DNA, 201 bp, Homo sapiens
tggatgtgagaggaagaccacacacacacacacacacacacacacacacacagacacacacagacacacacacacacactgagtttagatcaacaagcatmtactgagtgcccattaccaggtgtcatgctggaattataggcacaggtggagcctcaggagtcaagctctctgaattcacaccccagtttatctctcagt

SEQ ID NO: 27651 - DNA, 201 bp, Homo sapiens
ccaagggcatctcgtgtgttcacaaacacgcttcttatttatgttctagcaacccagctacagaaatagccatttggagcagcttctcagcccagcccttmgtaggcattctgttttcttgcccaggaagcggtttaagaaatcccccaaactacagctctggggacagaaaaactctcttctgtggagaaagtatccctt

SEQ ID NO: 27652 - DNA, 201 bp, Homo sapiens
acagaggcagccactatcattcaattagggttgacacttacatatttaccatctgtaataagcattctatctcaggattgtggagttaaattattatgctmctttataaaagaatataatgcactcaatattttcaagttacttttacatctaaaatctcatataccttcacaaaacctcagaaggtaggaagagcaggta

SEQ ID NO: 27653 - DNA, 201 bp, Homo sapiens
ttctcaacacagaggcagccactatcattcaattagggttgacacttacatatttaccatctgtaataagcattctatctcaggattgtggagttaaattwttatgctcctttataaaagaatataatgcactcaatattttcaagttacttttacatctaaaatctcatataccttcacaaaacctcagaaggtaggaag

SEQ ID NO: 27654 - DNA, 201 bp, Homo sapiens
tgccacttctgcctcgtatacacataactgacatcactaaatgactggcaccattgccagctgagcctggatgcagcctcatatccttctcaacacagagrcagccactatcattcaattagggttgacacttacatatttaccatctgtaataagcattctatctcaggattgtggagttaaattattatgctcctttat

SEQ ID NO: 27655 - DNA, 201 bp, Homo sapiens
cagagttttaaaaatctgattgaattcatttacaaactgttaactactagaaacaacctggcataatatccacctgattcctcatagatgggtaactagtrttattgatttgatttcactcatcctcagggattagagcaatctacttatggtgacttcttgcttgcttgcttttctttttctttctttctttcttttttt

SEQ ID NO: 27656 - DNA, 201 bp, Homo sapiens
acaatctgcctgggtttgaatccttgctctactacactagctgtgtgagtttaggcaagttacttaatgtccatgtgcctcagtttcctcatctgcaacayggggaaaataatagtgcctatttctttttgtttgtatttgtttctgtttttgtcttttgagatggagtttcactccgtcttgttgcccaggctggagtgc

SEQ ID NO: 27657 - DNA, 201 bp, Homo sapiens
agcaagtccatctggttcattgaaatttatctcacaaagagtagcaatttgaaagatgggaagagtggcacaaagtggtttagtttctataagtgcccccmccccccgccaactttgtgggggaaaaaaaaagcaacagcttccctttcactgcagcagcaacctgtaaggtaatggatcatttcagggcattcagatctg

SEQ ID NO: 27658 - DNA, 201 bp, Homo sapiens
gcctggaaccaaggtgtaatgaagcatttcaccggtcccactggacagggctgtgaatcatcttcctttcttacccagttggcacagatacatagcaactsaacagcattttgtctccggaacagtataatttccttaaattaccattaggtactagtgttgttttcactagcagcttgtacagggccagacatatctcag

SEQ ID NO: 27659 - DNA, 201 bp, Homo sapiens
tgaattaataaaattaattaaagcaagtcacagtaataaatacaaaattgacaagttttcaactctactctgtcactaattgatctcatccgccctcttcrctttacatatgatctacatgctaatgatttccaaactgttatcagctctgctctccttttgaactgttatcatctctgctcttcctttcaactttgaaag

SEQ ID NO: 27660 - DNA, 201 bp, Homo sapiens
ttcaactttgaaagttgaactttcaacttgaggcttataatttcaaccttacttgacttttccatgtgaatgcttaccagagaccttaaacttcatgtgtycctggtagcattactggttgcctaccttcacagtatcctttcacctcttacttcctataaaaatgcctccaattttgttcagtgagccactgtgaccagc

SEQ ID NO: 27661 - DNA, 201 bp, Homo sapiens
ctgggtctgcctatttttgacacacttttgtgtggacaataaattaattgattaatcaaagagcttgtttgcttaagatatggtttgtcaggattttggtycctctgcagctgaacacaaccacatatgacataacatacaaaacaaacattttgattttcatcttcaaagagcacctgatgaccacctccccaaccatct

SEQ ID NO: 27662 - DNA, 201 bp, Homo sapiens
gaagttgaatttctcaccagacctatggaacaggggcagaaaataataattacttactgagccaaaagtagagaagaataaataccattcagcaataaaawggaaggaagtacttaagtcatgccacaacatggatgaaccttaaaaacattatgtggccgggcgtggtggctcatgcctgtaatctcagcactttgggag

SEQ ID NO: 27663 - DNA, 201 bp, Homo sapiens
agtaaattgggaagtagggtagcagcatggttaaaaacatgtgcttggtggccaaagtccagctatgtcaattactctatgatctgaaaagagctacttamtctttctgagtcttagcaccttcatctgtaaaacagattagtaacaataataataaagtctaactcctggggttgccatgggaattcaatgaaacactgt

SEQ ID NO: 27664 - DNA, 201 bp, Homo sapiens
ctgaaaggaacattagaatttctttaatctaattctcttttttaacagatgagaaaattgagggttagagcagttacataagttgcccaaagctttatagyagttactggcgaggaaaaccagatcttttatctgtaacttaaaaattaaaaagctattggaatgagatagaaaaatgcttaagaagtaaaattgggcagg

SEQ ID NO: 27665 - DNA, 201 bp, Homo sapiens
tttaagagctgccctcaaaggcaaattaaatggtgtccattgtgctatttacaagggtcaggagaggttcttgggcatgataggagatgtggtaggaataygacagggtaaagcagttaaggactaaggagtagggattccaaactgaaattgctaggtccacctgctacgtattaattatgcaagaattactgtttgttc

SEQ ID NO: 27666 - DNA, 201 bp, Homo sapiens
tagagttccagtcttgtctgtctgttatttttaagcaccccaagggtgctaacttgtgcattgttttgcacagatttgcactgtgagttaaagaagtactwggttcaaatatgtaaagaaaaaaaggcagttaacattgcaaactatctactaacaccatcatctgggatgtcataaactaaaaaagatcaatctcaaaga

SEQ ID NO: 27667 - DNA, 201 bp, Homo sapiens
gctgaatggtgcaacccttactctaaagaaaaagaaagcccaggtgccccagagccttcccagtagacctgactagaataatgcctctgtctttccaggtrgacaagctaagtaaattaagcacttcagtgaccaagaaaatattgaattcctcctgaatctgcatgaattttgtctatttccagtatcctcaggaagcta

SEQ ID NO: 27668 - DNA, 201 bp, Homo sapiens
ccctgacttccatcttcaaacccatcaccaaaccagtcctttgaaggccaaggctttgggctgttctccagtctccttcacactcggtgggcctctgcacycttccctgtgttgacttctcattgtaggcctcccctgggattcatccttggtcacctgctgtcctatctgcgtgcttcctccctcagaaagctcatccat

SEQ ID NO: 27669 - DNA, 201 bp, Homo sapiens
tgtacaaccttatttccttccactttgcctgccctgtctccctactgcaccaagaccacgtcacattgtttctggtctctgcttcttgcattttgttctcrcctaaatttccctcctcactcttctctaccaatctcaatctacttgttatttagcccggctcaatctcagcttcctccctgagatgcacattcttcctat

SEQ ID NO: 27670 - DNA, 201 bp, Homo sapiens
ttgttatttagcccggctcaatctcagcttcctccctgagatgcacattcttcctattacttgacctcattcttcctattactgtagcacctgaaaccaayatttgaccccgatgacacattgtggcatattattccatgtagtttcaaaatgtaagtcattttttgtgtgtattagattataaaatccgttttctaaagt

SEQ ID NO: 27671 - DNA, 201 bp, Homo sapiens
taaggtaatggatcatttcagggcattcagatctggcctacattggcgctgatatttatccggcttattctggtattttcttcaggttaaacttgtactayttcagtgtcgcactgacagtgactttctttcttaatgttcacaacctggagggagtgaacaaggcatatacaaaaggtaacaacacattcacaatataaa

SEQ ID NO: 27672 - DNA, 201 bp, Homo sapiens
gctcagaggccttcacatccagcccagatcaggagctaagtaaaggtggcaccttcagtactgggtcctctgaactgggggccatccaggacttcatgagrcatccaggcccactttaactgggcccttaactggagttagagccacactaggtacacagattctaaagacagggatacttgtacccagggtacccacttc

SEQ ID NO: 27673 - DNA, 201 bp, Homo sapiens
ggaaaggaagagcaaggtaaaagagaacaaatgaatggaaagctatgtgtccagaatcacaggaatgaatacaggataataaaagagaagaaagatgtagstgaagggacagggacatattcaaggaaaagcttagtagtaaaggcatttacaaaccagtgagggaacttaaagatgaccagaaaagggagctaagcattt

SEQ ID NO: 27674 - DNA, 201 bp, Homo sapiens
ggagtagaatccagcattaacatggattttgttagtacaaggtattaatgtaatgccatgcttgtaatgggccccatgagctctggcccagacggctgggrttcatagtttgtactcctctcccattaggggtttctcagggtgaggactgagaggtgctgatatggaggagacacacatgtggcatagcacatgatattg

SEQ ID NO: 27675 - DNA, 201 bp, Homo sapiens
agaattgagggaaattccatttggcacaagcgtaatattatggggggtcggggtggggctaggaagctgaagacataagcagaaccaatcctgtggagcastttggacactaaaggcaacaggaagcctttgaagtgttttcagatctgtgctttagaaagatctcttcctggcaccgtgactggattggatgcaaggctg

SEQ ID NO: 27676 - DNA, 201 bp, Homo sapiens
tgcccaggaagcggtttaagaaatcccccaaactacagctctggggacagaaaaactctcttctgtggagaaagtatccctttcccctaacactgtggaargaccgagctgagccagttcaggtcaagtgttaggactctgtaagcactagctctagaagcaactaacaatgtctgggtttaccctgagcaatgttgcttg

SEQ ID NO: 27677 - DNA, 201 bp, Homo sapiens
gttcaggtcaagtgttaggactctgtaagcactagctctagaagcaactaacaatgtctgggtttaccctgagcaatgttgcttgtgaatctttgtctcasggagtttcttgtaaaaatcagcaccttcagcttccgcctgcagacccctctctgctgagcacaaacctagtccacaggctggtctggggagcagcctcat

SEQ ID NO: 27678 - DNA, 201 bp, Homo sapiens
ggctgcttctgcatatgatatcgcttatgtaacttttctttgcaaggactcctctggtgccccaatctagcctccacacccatccctccccatatcatcarcacaatgacatttttgctgctccacccagctgcgaatttgccaacagtttaaggatgtggacattgagtaaacaaagacacaaaattgaagttggctttt

SEQ ID NO: 27679 - DNA, 201 bp, Homo sapiens
tccccatatcatcagcacaatgacatttttgctgctccacccagctgcgaatttgccaacagtttaaggatgtggacattgagtaaacaaagacacaaaaytgaagttggcttttgtgcaactagcttttaggagttgcagttctgttctttcaggtttaaagtttcagtgcagtagaataagactgcccaaacaatattg

SEQ ID NO: 27680 - DNA, 201 bp, Homo sapiens
acatttgcacacacatatatttatctgacagtgcctgtctttacttttgcagtaaatttaagagctgccctcaaaggcaaattaaatggtgtccattgtgytatttacaagggtcaggagaggttcttgggcatgataggagatgtggtaggaatatgacagggtaaagcagttaaggactaaggagtagggattccaaac

SEQ ID NO: 27681 - DNA, 201 bp, Homo sapiens
ctcaaacaacaacaacaaaaagactaaaggaaaatatagaaatgcctccaggacaaactatcattcaccaaatgctcatttgggttacacaaatggaacawccttacaatatcttaagtcaaacagtggctttaatagatgtgagatgaagtgcccggggcaagatattggttctccaattttgatgtgcctgaaaatcac

SEQ ID NO: 27682 - DNA, 201 bp, Homo sapiens
tggcccaggcacgtctctcaatcaccttcccacctgaagaagcactaactagtaacacaagatgctgggtaggcagccccttctggaatctcaaacctgcrtctttcaaagttggccaggtgcggtggcgcacgcctgtaatcccagcactttgggaggccagggcgggcagatcacttgaggtcaggagttcgagaccag

SEQ ID NO: 27683 - DNA, 201 bp, Homo sapiens
cttacagtggacagagcctacgcatgcacacacacacacacacacacaccgcctttaaatcaggagttcacattaacacttccaattcaaatttaatgttmtcagatagtcaggaatttatgttaaggagcaaggatttaagttggccgtgagaggtaggtacaatatctttttaaaaaataattattttctataatacaa

SEQ ID NO: 27684 - DNA, 201 bp, Homo sapiens
gtgtagagggtggggacagtcaaatccaggtgagcagatccaaacaagtcattggcttaaagggattattgaagaatggcatgcgagacttgaatgggtcrgggaaagagaaaagctgaagtcctaagttgtaaaccagaaattgtcccagaaagctgtatttcgaaccaagagtaatgacctgtaggagagttattacat

SEQ ID NO: 27685 - DNA, 201 bp, Homo sapiens
ggttctcatttaagatggtttagtagcagtgattcattctatcaaaggcatcactgcatctttgatgcagacactatcatcctaagcctctttgcaatcartcccaagatgtataatttgtttagcctagtgaaattcttcacaattctctaaacaacttcaaatgtttctgataacttgaccctgcattccttggatcaa

SEQ ID NO: 27686 - DNA, 201 bp, Homo sapiens
caagggggatgtgacatagaaccatgtctaagagactaagcttagactctaggtcagataatataagttcaaatcaccatatcaccactgaaggatcatayatattttagtaagttacttaggcttttatttccttaactgaaacatgggattaggaaggcttacagctgcaagtaactaaacacccgtctactcatagct

SEQ ID NO: 27687 - DNA, 201 bp, Homo sapiens
ctactctggggccagagctgggacatttctgctgccctcagtagcaggtgaactgttaggcagcttacagggctgcattattagaaagtcctttttcctcytctggtcaaagaaaaattaatatctacagtcctcaattctccagtctcttccaagtactgtgccctacacaatgcttccctgaatgtacttttggaggga

SEQ ID NO: 27688 - DNA, 201 bp, Homo sapiens
tgcctaattaccatgcagcacagtaacaaccgtacatgccataaagcatgtgatcagttcattgattggaaagctaaactctgcaactatagggacagccratgtgcaaacactttgtgaattgaaaagtgttacagaaatgggagcagttcttgtcattaggctataaagaatgtctccttttgtatccttcctcatctt

SEQ ID NO: 27689 - DNA, 201 bp, Homo sapiens
tcctcaattctccagtctcttccaagtactgtgccctacacaatgcttccctgaatgtacttttggagggaggaaagggtatgcattcttaaacttcaaaytgaatgtaaaaagctttaaggggactatttggagaacttcctatgtgctccctagactttgtgagatggagtggctattatctaattgggggaaatgcaa

SEQ ID NO: 27690 - DNA, 201 bp, Homo sapiens
acaacacattcacaatataaacaaagagcaaagaaatctttatatttccctgtagattcctgctattttaagaagcagtggtggttgtgccacttattcaktttttagctatgagtcggatttgcagcattctcctccctagtctgtggctagaatagcgttttccaaactatgggccctactgctaaagaacacacaatc

SEQ ID NO: 27691 - DNA, 201 bp, Homo sapiens
ctgaccaactgaacatttccattatccagcgttcagcttttcccctgctgcattcccctccctccactaggtgggaacccatggatatctacactggctayatcaagcccagattccccacacatacacaccagtttgaccagccttaaaccaatatgtacctttatttaacttatgtaataagaagtccagagataggaa

SEQ ID NO: 27692 - DNA, 201 bp, Homo sapiens
ctcaacctttttttaaaaataaaacttcatctgattttaatcgactattgccatcatcgtcgataaatgtttcttgacagaatactgctgattctgagaaytgggaaagaaagaaattgtccagatagttctctgatatacttgggaaggacatacatctttatttatttatttattcattatttattcaataatggtgta

SEQ ID NO: 27693 - DNA, 201 bp, Homo sapiens
tttttgcgttaccctctttgaagtgagtaacactatgtcttagagagccttcttttcatttgtgttttagcctttctcatcgccaaagggctcaaaatgawgtccgtggagtctaagccaaaaagtaattcctcaagtgacagatctcatgctatgcttctctcttccactagctaaggccctcttactgggacagtggta

SEQ ID NO: 27694 - DNA, 201 bp, Homo sapiens
accttcactgtatgattctgttctaagaattccctttccttttcttcattgattatttattgtcctaaatcaccatctctttgaaaagtcctcacagggaygcagatattttccagaattgctaattgctgatttgaaagcatgaattctctcatctcatcaaatcggattctgtgtcttaaggtcagatcagcctttcta

SEQ ID NO: 27695 - DNA, 201 bp, Homo sapiens
aaggcgacagccccaaatgctgggctcttgccccaacactcatcacctcccttgtgtgaaggaaagactacagcccatctccagactgaggtggcaagtcktagaattggactaatcagtcattttcctctgacctaattaggaagttgtacctcttggcttttagtttgagaagagaaaaccagtggcctgttacctcag

SEQ ID NO: 27696 - DNA, 201 bp, Homo sapiens
cgcacaactctgtgaatataccaaaaaaaaaatgaattttataaatagttaaattgtatcaataaagctactacccccaaaaagtagagaaatgtgatgtytcttgtccacctgaggtgtactgagattcataaccattttatgtgtaaaatgtttcacaaagttatttgataaggttgtgtcaagctgaggtggtaactt

SEQ ID NO: 27697 - DNA, 201 bp, Homo sapiens
gcctaaaataaccggctaaaatggaactctggcctgttttctgaagccgctagggaaggtgtttccacaaccttcctctgttatgtgacccatttttaacmatctttaatatcataccagaaaacattgccttatatccaacctatatcccctctgctattgatttactgtttactctcacatgcatacaatgcaaatgtg

SEQ ID NO: 27698 - DNA, 201 bp, Homo sapiens
ggtataaaaagaattacaaagcccagtccttcccttccaagagctgacaatctgttggaacaggaacatacaaaaagcaaatgaacagtataagtaaaaaraaaactgtagccgtttgggaaaagaataaatcgttcctgggtaggttagcaatttcattttttttttttaattaatgttttccactatttcattctattg

SEQ ID NO: 27699 - DNA, 201 bp, Homo sapiens
aagggatggggaattagtcatagggtatttccagataatgtagttaacacctcgtgtaatattaggtgggcagggagctctgctctcaggaccaaaattgytcctgccagctctaatagggaatgtgtgtatttttaaagtctgggtaagcactgtgagtcatttccacaatacgcctccctttggcgtgaaatggggcag

SEQ ID NO: 27700 - DNA, 201 bp, Homo sapiens
tagcgtctaggggatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaa

SEQ ID NO: 27701 - DNA, 201 bp, Homo sapiens
agtcttctctttggtccctgataaatatacatagaatgtatggatgtgagaaagttaaactgatgtctgtgtgtcttcatgtcattaaactttgaatctayggacatgtctttttctttctggcatagtttggaggtcttcattttgtgattgaatacaaaacaccgagggctttaaggaggcatagtggtatgttcagct

SEQ ID NO: 27702 - DNA, 201 bp, Homo sapiens
tagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaag

SEQ ID NO: 27703 - DNA, 201 bp, Homo sapiens
aaatcacagagtccatttatttctcctcttcgagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggccc

SEQ ID NO: 27704 - DNA, 201 bp, Homo sapiens
cagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttct

SEQ ID NO: 27705 - DNA, 201 bp, Homo sapiens
ccatcatttacttacgtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatg

SEQ ID NO: 27706 - DNA, 201 bp, Homo sapiens
aattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcatattataagttgca

SEQ ID NO: 27707 - DNA, 201 bp, Homo sapiens
caacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttt

SEQ ID NO: 27708 - DNA, 201 bp, Homo sapiens
gttcattcagttatctcacgtttctggagggccctctatgtgcaatacctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaaga

SEQ ID NO: 27709 - DNA, 201 bp, Homo sapiens
cattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaac

SEQ ID NO: 27710 - DNA, 201 bp, Homo sapiens
gagcaagcatttctaacaatcatattgcttaagaagtggatggcaagaagataattactaatatgtctgcaattgatctgaaattgacacagttgatctcwctgattcatggggaccctgggagtatgtttgtgtatttgggggttgggatgggggggtgggtggagggtcagagaggtggcaaaagcaggtgggaacagg

SEQ ID NO: 27711 - DNA, 201 bp, Homo sapiens
tttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaaggcttcactatgttgccc

SEQ ID NO: 27712 - DNA, 201 bp, Homo sapiens
actttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaa

SEQ ID NO: 27713 - DNA, 201 bp, Homo sapiens
aaacatctgtgcaccagtaaagggttctgatgtgtgataaatttatttagctattactcatctgaagttatactattttaggatcttggggcagtgaggaytttggaaatggaacaggatgctcctttaagttagggtaaaatgaagtctataaaaactgtttttctatatcctcctcctaccccacaaagaaagttaggg

SEQ ID NO: 27714 - DNA, 201 bp, Homo sapiens
gaggaccttgtgttcctgctggagagtgagagtccctccctccccattccactcccaagagcagtgaagagtcaggaaggtgggcttgttttgttttgttwtgttttgttttgcttgttgagcaagggaatgcggttcccctgtgtcggacttgtttcagaaagacaatgtcactgaggctggggcagggagattagctga

SEQ ID NO: 27715 - DNA, 201 bp, Homo sapiens
taaatgaagcaccgccaggcccagttggggaggaccttgtgttcctgctggagagtgagagtccctccctccccattccactcccaagagcagtgaagagycaggaaggtgggcttgttttgttttgttttgttttgttttgcttgttgagcaagggaatgcggttcccctgtgtcggacttgtttcagaaagacaatgtc

SEQ ID NO: 27716 - DNA, 201 bp, Homo sapiens
aacccaactcctagccactgctttttgagcagctactcagtgcctaagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctattcca

SEQ ID NO: 27717 - DNA, 201 bp, Homo sapiens
tttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggccctgatttcagagatgaaagaaccaaggcatagaaattgagtcac

SEQ ID NO: 27718 - DNA, 201 bp, Homo sapiens
tgtgagccaccgctcctggcacccatcaaattttcaaaggaagaaatggaatggtgcaaccatggtacatgggaaggaggagggggacacacaagactgtrcctatcatgggggcttcgacctcatctgggaaggtggttggagagagtgagtcctgacctgagctttggaacttatcaagttgagagagaaatttgataa

SEQ ID NO: 27719 - DNA, 201 bp, Homo sapiens
ttgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcagggtggtcttgaactcctgacctcaggtg

SEQ ID NO: 27720 - DNA, 201 bp, Homo sapiens
gctgagaaaggattcccagtccccctggtaaaaagtctgaaggatgccgaggagttcactgtgcccttagataataacagtttgtcttggctctgatcacycctttttgtgacttagctggctgggaagtagcaaaagtatcttccaagctcagcttctctctgcttgcattctttccaaatacgtgattccaaagcccat

SEQ ID NO: 27721 - DNA, 201 bp, Homo sapiens
ttttttttttttttttttgtttttcctcccagcctctctcctttcccattatgcacaatgcgctgagaaaggattcccagtccccctggtaaaaagtctgraggatgccgaggagttcactgtgcccttagataataacagtttgtcttggctctgatcacccctttttgtgacttagctggctgggaagtagcaaaagta

SEQ ID NO: 27722 - DNA, 201 bp, Homo sapiens
tccccactttcaggctctcctttcacacgcatgcattaattcgttcattcttggaatctacccacctgtgatgtgctagttactaaagatgcagcaatgartgaaaggtaatcctgtccttgaggcattcacaggtaaagaagcctgcttgggacattgggccgtgagctccaacaatgtcactattcttctaggctttgt

SEQ ID NO: 27723 - DNA, 201 bp, Homo sapiens
caccacccaagttgtaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatcc

SEQ ID NO: 27724 - DNA, 201 bp, Homo sapiens
cattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcagatagaggaaagaa

SEQ ID NO: 27725 - DNA, 201 bp, Homo sapiens
caactgttctctgcacgacctagttctgggctagggaatggctgtctagcttcagtggatttccagggtccggagctactaaaggtcaacagctgtgttaytgcaaactctgtggcctgcattctatcaatgccaaaatgcacatcacactgacaacagctctttgtttacaccggggagcccccaaagccccagggtaat

SEQ ID NO: 27726 - DNA, 201 bp, Homo sapiens
ttgagaagggccctgtccgcagcctgaggagcctcaactgttctctgcacgacctagttctgggctagggaatggctgtctagcttcagtggatttccagrgtccggagctactaaaggtcaacagctgtgttattgcaaactctgtggcctgcattctatcaatgccaaaatgcacatcacactgacaacagctctttgt

SEQ ID NO: 27727 - DNA, 201 bp, Homo sapiens
aacctttttgatgcctccaggcaatttcctacaagctctaatatcttcctctttactcccatatgtggtatctctggtaccctatatatcattcactcaastgtttgttttgaaccacttattttggcaagacttcttcagacaggagagccctgagagctcttcaaaggctgggcctgatggtgtttgtcagagaggttc

SEQ ID NO: 27728 - DNA, 201 bp, Homo sapiens
tccattagagacctggcgtataattgtgggagggagaagccagtggagcagtcaggggactccctggctgtttctgtgtctggtcttatgggtctgggcaytgaattcagtcacaaaccctagcatgctcctttgctacctcaggggacaaagtcaagaaaataacactaggattgccaccctgctctctctctctctctc

SEQ ID NO: 27729 - DNA, 201 bp, Homo sapiens
aatagcacagcttttttccactttcaaatgtataacaaaatagaactttatatttccagatggactgcctggaacccggggagtggctcagctaccaggcyccagtggcccttgtcttgttatttcctccattagagacctggcgtataattgtgggagggagaagccagtggagcagtcaggggactccctggctgtttc

SEQ ID NO: 27730 - DNA, 201 bp, Homo sapiens
agttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcatggtccgcgtggcacagcgcgtggtccgcgtggcaca

SEQ ID NO: 27731 - DNA, 201 bp, Homo sapiens
ttggcctcccagagtgctgggattacaggtgtgagccactatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagct

SEQ ID NO: 27732 - DNA, 201 bp, Homo sapiens
ggttatttccttgaggagaaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggc

SEQ ID NO: 27733 - DNA, 201 bp, Homo sapiens
ttttcccttcttgataggttgtagattccatgtctaatccatgcttttccaatattccctcctaatctttcagttgaattatggtctttagctcaaatgcrtgacatgatgtgtgtgcctttggagtggggcggtattagtcagtcgatggttatttccttgaggagaaaggaaaggagaagttgagtacttttcagtgtt

SEQ ID NO: 27734 - DNA, 201 bp, Homo sapiens
ttattacagcgcaggtgcatcttgcttttgagtgctaactgagatgaaaggagtgaggaaacgctctcttcttcttgcaggggagggctggcaaattcagygaatgcagagtcggctgggagcctttcggctggaaagctcttcctctgatgagctgtctgttacagattttcagggatggcccttgataaggcaggggtg

SEQ ID NO: 27735 - DNA, 201 bp, Homo sapiens
ccttctcagagtcagtaggatagtttcccttcctggaagattgagatgaaataaagctttaggagttggtatcgcacgcaggcattaaatggattgtgaasagggactttgttcccgctcagtcttgtctctgcctccgtaaaggagtaagttaaaaaagaaagtttctttttttaaaaaaaagccttactgctcaataaa

SEQ ID NO: 27736 - DNA, 201 bp, Homo sapiens
ccgctgatctgcatagcacttcgcaatgaagctgtgctctagaaacataccacgatctactggactttcttaaataaggtggttgttcaggaaattcctcyagttaattttactttaattccccctacaagaatgccgagacacctctgcctattttctctttctgtgtttgttgtttcttttgtttttgttttcgagact

SEQ ID NO: 27737 - DNA, 201 bp, Homo sapiens
cctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaataca

SEQ ID NO: 27738 - DNA, 201 bp, Homo sapiens
ctcaaatttctggctggtacaccctgggtaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtca

SEQ ID NO: 27739 - DNA, 201 bp, Homo sapiens
actaccttgcttgcctatgggacatgttcccatttcagtgcatacttgacctttaccataaatcacatatttgtaaactgtaccctcctgctgttttattrggcatggagaagcagtcttttctttttcttgatggcctgggttgaccagatcctgacttttgtggagacattaaagtgctagaaatgataatggtgaaag

SEQ ID NO: 27740 - DNA, 201 bp, Homo sapiens
acaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgttttttttttttaaattaaggatgctgtatga

SEQ ID NO: 27741 - DNA, 201 bp, Homo sapiens; identical to SEQ ID NO: 4862

SEQ ID NO: 27742 - DNA, 201 bp, Homo sapiens; identical to SEQ ID NO: 4884

SEQ ID NO: 27743 - DNA, 201 bp, Homo sapiens; identical to SEQ ID NO: 4874

SEQ ID NO: 27744 - DNA, 201 bp, Homo sapiens
atatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttt

SEQ ID NO: 27745 - DNA, 201 bp, Homo sapiens
atgttagttattattttaatattacagcatctgtggaaacagtgggtttatatttcagcgtcctgagaaacactcatcctgaacaacgggaacattggccrcatccgccattgtcaattttaaataaaagatatgatgactagttggtgagttgatcttgtaagacttttacagatacccagaacggctctacttcttcat

SEQ ID NO: 27746 - DNA, 201 bp, Homo sapiens
tagaggatggatgggagcatgaagtgtcctccgtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaa

SEQ ID NO: 27747 - DNA, 201 bp, Homo sapiens
tgcaacttgtcaaacacttacatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttat

SEQ ID NO: 27748 - DNA, 201 bp, Homo sapiens
actctacttaaaattaaggcataaagtaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtgggttcagtaaggaagaaggttttgtat

SEQ ID NO: 27749 - DNA, 201 bp, Homo sapiens
acccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttcgaagaggtccaggacatttaaatagc

SEQ ID NO: 27750 - DNA, 201 bp, Homo sapiens
ttttttttttttttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagag

SEQ ID NO: 27751 - DNA, 201 bp, Homo sapiens
taagcatatttatatatatatacacataaaacatatatgtacatattatcataatgcctacctgctcttgagaaagtagtgccgtatggctgggggtttckctcactggtttctatggctctcccctcccccactttttctaagaagtggtagtacctatctgactattttcttggctgcctgaagaggcctcaaaattag

SEQ ID NO: 27752 - DNA, 201 bp, Homo sapiens
tgaaaaaaaataaacaaaatacttctgcaacagcagcagcaagagctgccgcaatgaaagaagaaagaaaaggagggacaggatgaaggaaagaagcagtrttaacattctagtaatatttgcatctgaatgatatttatatggggttattgtcctccctttgtgtatgtttaaaattttcataataagcatatttatata

SEQ ID NO: 27753 - DNA, 201 bp, Homo sapiens
ctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaat

SEQ ID NO: 27754 - DNA, 201 bp, Homo sapiens
atattgcttctgatttttgttgttttgctatcatagcgttacctacctcacagagatgttttaggtcataagtatttttcatttaattttttttccccttmatttcctttttttccctcctaagctataaatatacagccttaaaaaaaacactcagaaatttaagtccaagaagcctgcttttcttgatacctttcaagt

SEQ ID NO: 27755 - DNA, 201 bp, Homo sapiens
aaattcagcatctcaaatgtacctttaatattgcttctgatttttgttgttttgctatcatagcgttacctacctcacagagatgttttaggtcataagtrtttttcatttaattttttttccccttaatttcctttttttccctcctaagctataaatatacagccttaaaaaaaacactcagaaatttaagtccaagaa

SEQ ID NO: 27756 - DNA, 201 bp, Homo sapiens
ttgatcttggacttcccagcttccagaaccatgagcaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatcc

SEQ ID NO: 27757 - DNA, 201 bp, Homo sapiens
aagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctgccttatttgtaacaaacaaataaacaaaaaacaaa

SEQ ID NO: 27758 - DNA, 201 bp, Homo sapiens
agaagaggatgtagggcaggtagggctcagaaggacccatgccatatagcaaagttcttagtaacacaggctttgggttacagcaggctagattcaaatcytgctgtggtcagaatgtctgtgtcaccccagcattcatttgttaggagatggggtcttttgggagatgatttggacatgaagacagagcctgcataattg

SEQ ID NO: 27759 - DNA, 201 bp, Homo sapiens
gagttcaagacctcctcatctctacaaaaaataaaatatttgaaaaaaaaaagtgaaatttttgatatagaagaggatgtagggcaggtagggctcagaargacccatgccatatagcaaagttcttagtaacacaggctttgggttacagcaggctagattcaaatcctgctgtggtcagaatgtctgtgtcaccccagc

SEQ ID NO: 27760 - DNA, 201 bp, Homo sapiens
gtgctggccttttcactcaagttctctgatgtaactgcccacagtaatcctgtaaggtatggctaatcatttccattttatagattaggaaaccaaggtcmaaagtggtgaattgatttgaccaaaatcacagacccaggaatttcctcagccaagagcctacagcagctgtgtcttaagactgtgccctttcatccaccc

SEQ ID NO: 27761 - DNA, 201 bp, Homo sapiens
gtgcagtgaggatgaatcaacaagtaaatatcatgagaatttcttagattgaagaaatattactcctatttggtgtcaactctgtgctggccttttcactsaagttctctgatgtaactgcccacagtaatcctgtaaggtatggctaatcatttccattttatagattaggaaaccaaggtccaaagtggtgaattgatt

SEQ ID NO: 27762 - DNA, 201 bp, Homo sapiens
gtcagctggtgggtgatctccactgaactcctattcagaggctcagtttctctgcaggacagaaatgagaggcacaaaatttcatagctgtcttgcccctyctgtggtctgtaagaatgggaccaggactcctagttgtgaacccgaaaggatttccattaggatcaggaagtgtgagttggcttagaaaaagtaaagaaa

SEQ ID NO: 27763 - DNA, 201 bp, Homo sapiens
accctctgattcaggctcagcaggagcgggagaggatgcataggactacatgttttctgggccaggactggaagcagcatatctcagatccaacctctttmccttggcaaaaattcaggatgtgcaggacgaggaggaaaatgggagtagtgactatttagccagtctttgccacatcccggttcatatctcactccgtca

SEQ ID NO: 27764 - DNA, 201 bp, Homo sapiens
ttcttgttctcgtatcactcagactaagcagttgatgtaacagataacccccaaatttcagtgatttcacatttaatctgtaaaaaatgaggatttgtttrtagccccaaagacagtctagtttggattatttgaggacctagacttcacctgcacagtggtttcaccatccatccccccatggcctccatggtaccctct

SEQ ID NO: 27765 - DNA, 201 bp, Homo sapiens
cctgtagataatacagtcccattctctggggaaacagatacctccgccagggtcctgatctgaatatgatttggggtgatggaacagaaacacccgaggastgtcgttggggaacaggaaacctgtctgtagtcctggctctgtctccaattggctacgagggcttgtgtgtactctagttctctttccgtgacactgcat

SEQ ID NO: 27766 - DNA, 201 bp, Homo sapiens
cattgccctccattcagatcttgtcacttaggccttggtagcatgagctattaacagccctccatatttactatttttttttttttttttaactctgggasttcctgttgcagaaattggatcacttacctaaaaagctccccacccccacctttggtgactggtgggtttcatcaccaggaaagcacattgttccaactc

SEQ ID NO: 27767 - DNA, 201 bp, Homo sapiens
taaaggcttactgggtatcagggctgctttcctttataatcttttacccgtcttatgggggatgaacagaaacacactttagtgctagaaaagctgggccyaaaagaccagtctcctgtcccatacttggacatttattgttctttttgggcaaggtgaaaacttgaaaccaaaagtctgttgagtttggaagacttgact

SEQ ID NO: 27768 - DNA, 201 bp, Homo sapiens
ttgtagctcctgtgaagattcaggaattttttttttcttctatttgcaagctttagtcctaggcatggaaaaagaactttgaagaaaacctgagagatatsagtgtaaaacaagagaatgattccctctggggtgctggtagtgggggcttaatttcctaaaggcttactgggtatcagggctgctttcctttataatctt

SEQ ID NO: 27769 - DNA, 201 bp, Homo sapiens
gcgcatttgagacaggttgagggttcaagctgtccaatccctgctcatctgcagcacaccaaggaatgtggactaatgaaaaataaactgcatgcatgcartgcccatcacactgcctgcattttctaatcttcacaataactctgtgttgagaaatattcctgtctgtaatcccggcactttgggaggctgaagcgggca

SEQ ID NO: 27770 - DNA, 201 bp, Homo sapiens
gggagcaggggaggaaccatctgaggtgtttttttttttttttttagatttctcattgctgagaacagttccagctctgctgaccaaaggctgagtgtccytttattagtctgagcccctagagagaccaaagaggcaaccctcgagccaactgacagccagctgtggggttggaccctgtttttcatacagtgagcactc

SEQ ID NO: 27771 - DNA, 201 bp, Homo sapiens
tgtggtgtgcggtgcaacccgggctgtgttcccgagtgcatcaaacggggattgggacctgttttccttcccactcacatgtaggtcacctacgggagcargggaggaaccatctgaggtgtttttttttttttttttagatttctcattgctgagaacagttccagctctgctgaccaaaggctgagtgtccttttatta

SEQ ID NO: 27772 - DNA, 201 bp, Homo sapiens
tctccgacttatgtatgattcatcaagaggactccaggctgtggtgtgcggtgcaacccgggctgtgttcccgagtgcatcaaacggggattgggacctgktttccttcccactcacatgtaggtcacctacgggagcaggggaggaaccatctgaggtgtttttttttttttttttagatttctcattgctgagaacagt

SEQ ID NO: 27773 - DNA, 201 bp, Homo sapiens
aggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttct

SEQ ID NO: 27774 - DNA, 201 bp, Homo sapiens
actctcatgacataattacctcccaaagtccgcacttcctaatgttaccactctggaggttagaatttcaacatataaattttggggggacacattcagaycacaataatgttttataatgttcattttgctttaacaagagacacatgtcagatagtagacatgatctgagaagacacaaaacccagcgtggtgattttg

SEQ ID NO: 27775 - DNA, 201 bp, Homo sapiens
gaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacat

SEQ ID NO: 27776 - DNA, 201 bp, Homo sapiens
aagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacac

SEQ ID NO: 27777 - DNA, 201 bp, Homo sapiens
agaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagt

SEQ ID NO: 27778 - DNA, 201 bp, Homo sapiens
gcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccac

SEQ ID NO: 27779 - DNA, 201 bp, Homo sapiens
aggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgatgagaatggaaacattccataggacgcaga

SEQ ID NO: 27780 - DNA, 201 bp, Homo sapiens
actcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatctcctacgg

SEQ ID NO: 27781 - DNA, 201 bp, Homo sapiens; identical to SEQ ID NO: 23320

SEQ ID NO: 27782 - DNA, 201 bp, Homo sapiens
tcccctttccaatacatctctctctctctttctctctctctctctctctctctcacacacacacacacacacacacacacacagccaaatcagacaccaayataaactgtagagttaacattctttttccaccctcacactttttttagctccgatctgtgttcaatttctgcctgagagagtgatatattcatatattta

SEQ ID NO: 27783 - DNA, 201 bp, Homo sapiens
aacatggtgaaaccctgtctctactaaaaatacaaaattttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtct

SEQ ID NO: 27784 - DNA, 201 bp, Homo sapiens
gagtaaaagtcctttatgattagcaaattgcaggtcctcccctttctgatatttacagcccttgcaaccgcctgtacaaaaatcgggaaaaggcagaagasggctgtcattaatgtaaaagcagctggttacctccccctccccagcgcacacatcacctcctagtacaattagtcaccatgtcttttcccttccgtcaag

SEQ ID NO: 27785 - DNA, 201 bp, Homo sapiens
agagtaaaagtcctttatgattagcaaattgcaggtcctcccctttctgatatttacagcccttgcaaccgcctgtacaaaaatcgggaaaaggcagaagmcggctgtcattaatgtaaaagcagctggttacctccccctccccagcgcacacatcacctcctagtacaattagtcaccatgtcttttcccttccgtcaa

SEQ ID NO: 27786 - DNA, 201 bp, Homo sapiens
atgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcg

SEQ ID NO: 27787 - DNA, 201 bp, Homo sapiens
ataaaaataaaaagtcaaaaggaaacaaacaatgttgctgagaagtgatagaatattctagtttatatctcagtcattttacagctctggcatttctgggkaacactttagaatacttccactccggttggtccataaaaagctgcctgtgtttttatgttttgaaaatacacgcagagagacccactgcatgtcctatta

SEQ ID NO: 27788 - DNA, 201 bp, Homo sapiens
attttaagcaactgacccttgggataaaaataaaaagtcaaaaggaaacaaacaatgttgctgagaagtgatagaatattctagtttatatctcagtcatwttacagctctggcatttctgggtaacactttagaatacttccactccggttggtccataaaaagctgcctgtgtttttatgttttgaaaatacacgcaga

SEQ ID NO: 27789 - DNA, 201 bp, Homo sapiens
ttcaccatgttggccatattggtcttgaactcctgacctcaagtgatcctcccgcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatag

SEQ ID NO: 27790 - DNA, 201 bp, Homo sapiens
gagcactggatacctagactctgctgggctctagagaagtgctgggctacagcgcccagtgccctacctcttggggccagccagcctcaccaaaaaatcasgcttctggcttgctccaaactcaggaagttgctgggaagtctggctagcaacaccctcattcccagtcctggccatgcctctctgctctccctagcacag

SEQ ID NO: 27791 - DNA, 201 bp, Homo sapiens
aagagactggagaaagccaatctgtttctccctgaaaatcatcttacttttttaacgcttcgtacctagatttggcctgggcagcccagggagactgttcragcactggatacctagactctgctgggctctagagaagtgctgggctacagcgcccagtgccctacctcttggggccagccagcctcaccaaaaaatcag

SEQ ID NO: 27792 - DNA, 201 bp, Homo sapiens
gcccatcccaaatgaattctaatcctcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtg

SEQ ID NO: 27793 - DNA, 201 bp, Homo sapiens
tcgagttcttaatctgagcagtttcgaaaccaagcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatatta

SEQ ID NO: 27794 - DNA, 201 bp, Homo sapiens
cttaggcatccatgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataagttgatgtgtttttgtatatgcttatgtatatgc

SEQ ID NO: 27795 - DNA, 201 bp, Homo sapiens
gaagtgggcgtcgtgatgccagtgtcttcgtaatactatctttctttcccctttagcacccagaacttatgaaatatgactcggtttatcctgaacacatstctgtgcatcagggaggatgggagaattaattccagtttctcaattgcaaaagtgaggctggtcatggggcttggaaccacgccacggacgcatgaagcc

SEQ ID NO: 27796 - DNA, 201 bp, Homo sapiens
tgctctcatttcattttcactgaactgaaaataaggtaacagaccctcaggtctacctataagtaccttccaactgttccacttttgtaaatttagttcarataatacatatgctgaaattcctatatcccccccatactccagatcttcagtgtggaatttaaatataattccttattgtaaaaaaaaaaaatttttttt

SEQ ID NO: 27797 - DNA, 201 bp, Homo sapiens
gcacctgcatgttgtaaaaacacaaaataaaaaaaaaataaataaaagcagaccccttggttcagatatctttgtttgtgtaaatgttttggcattctttrtgaaaatcttcagattttcaagagcttaagatgacctcctctagccggctgcagcagtgtctaggtatctgtgaatgtgtaagaaattgagacagcctgc

SEQ ID NO: 27798 - DNA, 201 bp, Homo sapiens
cgctgccattcagttttactctgcacaaaatacagccaacatttttgcatttctttcttccttcctccttttcttctttctttccttccttccttcctttytcccttcatctatctttgttccgcttttgtttgtttttttttagatcgctgcatgctgccgcgttgggttaaccatggtagcattttaccatgagaagcc

SEQ ID NO: 27799 - DNA, 201 bp, Homo sapiens
ccttccaacatctagcattattgtgtgttgaataaatacttgttcgattaggtctaatcactcttcatgattggatttccaaaatgtggactctcagcagkacattacagggacagtggttgggtctggagatgtcacccttagctgtttttcacaatgagaggttgttttatcataaataaatcaataaatggcagatta

SEQ ID NO: 27800 - DNA, 201 bp, Homo sapiens
tctgatggccagtgatgatgagcattgtttcatgtgtctgttggctgcataaatgtcttcttttgagaagtgtctgatcatatccttcgcccacttgggtsgatgaagctggaaaccatcattctcagcaaactgttgcaaggacaaaaaaccaaacaccgcatgttctcactcataggtgggaattgaacaatgagaaca

SEQ ID NO: 27801 - DNA, 201 bp, Homo sapiens
cactttaaacattgcatccttgagttgcatatgatgggatctcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaac

SEQ ID NO: 27802 - DNA, 201 bp, Homo sapiens
aggctagccaatcatttcaaagcctgtgtagaatatctagactatatgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgt

SEQ ID NO: 27803 - DNA, 201 bp, Homo sapiens
aaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctaaaaaaaataaccacccgttactttgctgcttttagaaaataggtt

SEQ ID NO: 27804 - DNA, 201 bp, Homo sapiens
tggccatggaattgagaagcaggagcatggctcacaaattcacaaatcagcttctccactaatgaggggtgaggaagttaaaatatagactttgttgttgktgctgttttaatgaagaggctggacattaaaatcaaggggaggaataatcatgtcttctcttgaaatgggcagtgaacttcccggaaccagagtgttgcc

SEQ ID NO: 27805 - DNA, 201 bp, Homo sapiens
tagtgtcaagcagtacaggctttattcaatggccatggaattgagaagcaggagcatggctcacaaattcacaaatcagcttctccactaatgaggggtgrggaagttaaaatatagactttgttgttgttgctgttttaatgaagaggctggacattaaaatcaaggggaggaataatcatgtcttctcttgaaatgggc

SEQ ID NO: 27806 - DNA, 201 bp, Homo sapiens
gggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgaggaagttaaa

SEQ ID NO: 27807 - DNA, 201 bp, Homo sapiens
ggccacaaaaatcatgtcacaagatcttgttgatgtgcatgcattcattcattcaacaaatattattgagcatctaacataagccgggtgctttgctaggkacagaatgctgtacaaggtccctgtcctcatggggaccgtatgttgggaagacagatgataggcatggaaatgaagagacaaaccactccgacttcagcc

SEQ ID NO: 27808 - DNA, 201 bp, Homo sapiens
tagagtctggattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgc

SEQ ID NO: 27809 - DNA, 201 bp, Homo sapiens
ttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagc

SEQ ID NO: 27810 - DNA, 201 bp, Homo sapiens
tactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagc

SEQ ID NO: 27811 - DNA, 201 bp, Homo sapiens
gtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacct

SEQ ID NO: 27812 - DNA, 201 bp, Homo sapiens
ccagaatgagtgtgttttctagctgtcactgcctgatgtttactgctcaaagcttaggacttggattagagcccaggacttggcagccaagataaaccagstgcaattacgctgaacatctcagcccagctcctgtccatccctgaacaggacacttagggtagaggatgttctcagcagtgccatttgcatcccccttca

SEQ ID NO: 27813 - DNA, 201 bp, Homo sapiens
tacaggattttacatggcttagagaaatactgtggtggtgaaaatatgcataaaaaagcgagagattttacttttgaaatgctgccaaagtgaaatctctyttggataggcagatgacagtttagtacttgcaggtctttcgattctgacaactgtcagaagtgaatttaagtgctggtgactaggctgccagagaaacac

SEQ ID NO: 27814 - DNA, 201 bp, Homo sapiens
aagaccaacgtgtaaattacatattaatctttctttttctccctagctcggttttaagaataatgttttagccaacatatctgcattactcttggctcaayatgagaaatccatttttggtttgcctaacagaagatcatgttgctttgcttctctacacagtatgaaaacccaaagaaaagaaaaacagaggcagttttt

SEQ ID NO: 27815 - DNA, 201 bp, Homo sapiens
gaagagattctcgtccgctcagttaaggtactcagactattttccaaccaatcaagagggtgctgcttcatggagttcgtttaagctgaagcggcagctgktgactgtcatttgcatcatctttatacatttactgtgaatgtcactgtccatttccactttctttctacttgtcttcaaattgatgcttatcaagtagac

SEQ ID NO: 27816 - DNA, 201 bp, Homo sapiens
acagagcctcccttctacctgctcttacccgggcaccacagttgatgagttattttttggaccatcagcaacacacccaatcattgtacatggaatacttyggggatgcttttttctatattgattttacttcattaaactgagctccagaggagcagaaactttggctaatacatcttggtcttagcttgtaatatctgt

SEQ ID NO: 27817 - DNA, 201 bp, Homo sapiens
cctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccact

SEQ ID NO: 27818 - DNA, 201 bp, Homo sapiens
tgcatagacatttgcaccccagggatagcaccattactcccaaaaattgcaggtttgaaagggtacctaaaaacaagccaccagattgtcccattccactrtcattctgccatcaacaccgaggtgtcggagtagcaggagagccacatatttcttagtgaggggacccagaatgatcccttttgtgctagaggatctgag

SEQ ID NO: 27819 - DNA, 201 bp, Homo sapiens
cccaaaaattgcaggtttgaaagggtacctaaaaacaagccaccagattgtcccattccactatcattctgccatcaacaccgaggtgtcggagtagcagkagagccacatatttcttagtgaggggacccagaatgatcccttttgtgctagaggatctgagttcatttcatgaaactgaagcatcttcttggagatata

SEQ ID NO: 27820 - DNA, 201 bp, Homo sapiens
gcaggagagccacatatttcttagtgaggggacccagaatgatcccttttgtgctagaggatctgagttcatttcatgaaactgaagcatcttcttggagmtataagctcaccttgggataggcccttgcagatgacaataaaggtattttggcacataaaaaaactgctcagcacaccttgtatttgtatttcctttgac

SEQ ID NO: 27821 - DNA, 201 bp, Homo sapiens
ttagtgaggggacccagaatgatcccttttgtgctagaggatctgagttcatttcatgaaactgaagcatcttcttggagatataagctcaccttgggatrggcccttgcagatgacaataaaggtattttggcacataaaaaaactgctcagcacaccttgtatttgtatttcctttgacgtgaaccatggccatccagt

SEQ ID NO: 27822 - DNA, 201 bp, Homo sapiens
gccacgcaacattcccactgccatgttggcttgtttttcttttgttttcttgtcaacataagcctcatgagacaacagcaggatgcaagattgtacaatgrcaccatgactctgctttctgggtgtcctctgtgggctctcagcagtgtccccgatgtggagggtcttcttattctgtgtgtgtgccctctgctgttgaaa

SEQ ID NO: 27823 - DNA, 201 bp, Homo sapiens
ccactgccatgttggcttgtttttcttttgttttcttgtcaacataagcctcatgagacaacagcaggatgcaagattgtacaatgacaccatgactctgytttctgggtgtcctctgtgggctctcagcagtgtccccgatgtggagggtcttcttattctgtgtgtgtgccctctgctgttgaaagttgcctgtcaccc

SEQ ID NO: 27824 - DNA, 201 bp, Homo sapiens
caacagcaggatgcaagattgtacaatgacaccatgactctgctttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgccta

SEQ ID NO: 27825 - DNA, 201 bp, Homo sapiens
tgcaaatgataccatcacgaaagtgtacagatgacctacagaatgggggaaatacttacaaattaaatattaaataagggatttgtatctagaataaagamcttttacaattcaataatgaaaactcatttaaaaaatgagcataagatctaaatagatattcctccaaatatgatacacaaattgccaatgaatacataa

SEQ ID NO: 27826 - DNA, 201 bp, Homo sapiens; identical to SEQ ID NO: 8502

SEQ ID NO: 27827 - DNA, 201 bp, Homo sapiens; identical to SEQ ID NO: 8503

SEQ ID NO: 27828 - DNA, 201 bp, Homo sapiens; identical to SEQ ID NO: 8504

SEQ ID NO: 27829 - DNA, 201 bp, Homo sapiens; identical to SEQ ID NO: 8505

SEQ ID NO: 27830 - DNA, 201 bp, Homo sapiens
gtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagac

SEQ ID NO: 27831 - DNA, 201 bp, Homo sapiens
ctgcagaactgaggtgggccccaaaacttgcgtttctaaaaggtactagctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgca

SEQ ID NO: 27832 - DNA, 201 bp, Homo sapiens
agtgcacctgaccctaggataatcttaattttaagtaactggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtt

SEQ ID NO: 27833 - DNA, 201 bp, Homo sapiens
gttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatcgcaattgagcatatagtacatgctgtcctgtgtacccact

SEQ ID NO: 27834 - DNA, 201 bp, Homo sapiens
gctgttcttaactctgaaagcagagtgggccatttgaatgctcactttgatattttttaaaggaaaaatttgaggcattgacacatgccttttgcttactygcttggattggtttgatcaactttgttgcggtctaatttatgtaaaataaattgcatccatttaaatatacaattcaatgagttttgacagatgcacatg

SEQ ID NO: 27835 - DNA, 201 bp, Homo sapiens
tttagaaatatttctaacctctggccttttttcttatctctacttaaagcttttctggaaggaattcattttccactttccttaatgttccttaaatgttstacatatcttaaaagtggattcctcataaaacaatatggactatggtcttattctgtttaacggtatgaaagctcgcctgaaaggccaagagtaagattc

SEQ ID NO: 27836 - DNA, 201 bp, Homo sapiens
ggaaggaattcattttccactttccttaatgttccttaaatgttgtacatatcttaaaagtggattcctcataaaacaatatggactatggtcttattctstttaacggtatgaaagctcgcctgaaaggccaagagtaagattcttttaaaatcatgcccaagttttaaaggaatataaaactttctctttaaaaatata

SEQ ID NO: 27837 - DNA, 201 bp, Homo sapiens
cgcctgaaaggccaagagtaagattcttttaaaatcatgcccaagttttaaaggaatataaaactttctctttaaaaatatacctttctgctttcatcccytaacccacaaagctcaagtctagtttaattcaaacttggaaatagttcttttattattgctccctgcaatgggaacagagctgaggctcctaaggtctag

SEQ ID NO: 27838 - DNA, 201 bp, Homo sapiens
ccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtggtgatacattaatggaggcaacagagggtcagaaatcaggg

SEQ ID NO: 27839 - DNA, 201 bp, Homo sapiens
tcagaaattgggaaggagggtcaggtagctataagcaaaatacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccaca

SEQ ID NO: 27840 - DNA, 201 bp, Homo sapiens
aggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatgacttgaacaacaaaaatacattttctcatagttgtggagcctagaattcc

SEQ ID NO: 27841 - DNA, 201 bp, Homo sapiens
tccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactgtggccatgaaaccttgcct

SEQ ID NO: 27842 - DNA, 201 bp, Homo sapiens
caaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgaagcaggagaatttctggaacctgggaggtggaggttgaagtgagctgagatggcaccattgcac

SEQ ID NO: 27843 - DNA, 201 bp, Homo sapiens
agcctggccagcatggtgaaaccccgtctctactaaaaatagaaaaaattagccgggcatagtggcatgagcctgtaatcccagcgactcgggaggctgargcaggagaatttctggaacctgggaggtggaggttgaagtgagctgagatggcaccattgcactccagcctggcagacagagtgagactccatctcaaaa

SEQ ID NO: 27844 - DNA, 201 bp, Homo sapiens
gtgaaaccccgtctctactaaaaatagaaaaaattagccgggcatagtggcatgagcctgtaatcccagcgactcgggaggctgaagcaggagaatttctkgaacctgggaggtggaggttgaagtgagctgagatggcaccattgcactccagcctggcagacagagtgagactccatctcaaaaaacaaacaaaaaaaa

SEQ ID NO: 27845 - DNA, 201 bp, Homo sapiens
atacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagacct

SEQ ID NO: 27846 - DNA, 201 bp, Homo sapiens
gctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctagg

SEQ ID NO: 27847 - DNA, 201 bp, Homo sapiens
tccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagt

SEQ ID NO: 27848 - DNA, 201 bp, Homo sapiens
ggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttccctt

SEQ ID NO: 27849 - DNA, 201 bp, Homo sapiens
tcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaa

SEQ ID NO: 27850 - DNA, 201 bp, Homo sapiens
aggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcttggtgcttgtaggagaggcatttatttcttttaggactggacggggcttggagggtttcca

SEQ ID NO: 27851 - DNA, 201 bp, Homo sapiens
acactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaata

SEQ ID NO: 27852 - DNA, 201 bp, Homo sapiens
agaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggtt

SEQ ID NO: 27853 - DNA, 201 bp, Homo sapiens
gaaaagtatgttaagacaaaatgagcaggtggttggattagtattttctttctacacatatagaaactgttcctatcatacctgactcagttttcaaactkgcttaatccaaagcctggggggtggatgtaggagagaagttgaaattagctggggttttttttttgtatcacaaaagttacatttttttttttttttttt

SEQ ID NO: 27854 - DNA, 201 bp, Homo sapiens
tggaactacaggtgcccgccaccaggcctggctaattttttttgtattattagtagagatggggtttcaccgtgttagccaggatggtcttgatctcctgwccttgtggtccgtctgcctcggcctcccaaagtgctaagattacaggcacgagtctccgcacccggccctgtttttgcatttttagtagagacgggtttt

SEQ ID NO: 27855 - DNA, 201 bp, Homo sapiens
gacgggttttcaccaggttggccagcctggtctcaaactgttgaccttaggtgatctgcctacctcggcctcccaaagtgctgggataacaggcgtgagcmactgcgcctgtctacattttctgtctttactggtattatggtgggaacccataaaccactgcgaggcagataccattttaagcaggaaaccttatttttt

SEQ ID NO: 27856 - DNA, 201 bp, Homo sapiens
gaccttaggtgatctgcctacctcggcctcccaaagtgctgggataacaggcgtgagccactgcgcctgtctacattttctgtctttactggtattatggygggaacccataaaccactgcgaggcagataccattttaagcaggaaaccttatttttttccgaagcacatttaaaaatattttccagtttatctattaaa

SEQ ID NO: 27857 - DNA, 201 bp, Homo sapiens
ctctgaaagatttatctctttcgattcatctgtaaagtaaaaataaccgtcgtcgtcatttctcaagcgtgacgatactgttacacgtttactgcatattstgcataccaagcacatatccgtcacacgcagtgtggccaacttccgagaggccggcattcagccaaacagcctgaagaaccaggagaaatgcctgagttt

SEQ ID NO: 27858 - DNA, 201 bp, Homo sapiens
ttcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgt

SEQ ID NO: 27859 - DNA, 201 bp, Homo sapiens
aaaataatattaccggagaaacaatgagtaacatgtataggattttttttttttttttttgacggagtcttgctctgttgcccaggctccagtgcagtggygtgatgttggctcactgcaactccgcatcctggtttcaagtggttcttctgcctcagccttccaattagcggggactaccagcgcatgtcaccatgcctg

SEQ ID NO: 27860 - DNA, 201 bp, Homo sapiens
gaaggcaatactattatgctcattcataattaaggcaattgaagcccagacccttccagtagctttcctgaagtcaagttgccagtgcattggacatactrggctgtagttccagggcagcctggctctggtgtctttgctgcaatgacaatatctccccatttctctgtttaaataccacacactccccatatggtttct

SEQ ID NO: 27861 - DNA, 201 bp, Homo sapiens
tgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctca

SEQ ID NO: 27862 - DNA, 201 bp, Homo sapiens; identical to SEQ ID NO: 8506

SEQ ID NO: 27863 - DNA, 201 bp, Homo sapiens; identical to SEQ ID NO: 8507

SEQ ID NO: 27864 - DNA, 201 bp, Homo sapiens; identical to SEQ ID NO: 8508

SEQ ID NO: 27865 - DNA, 201 bp, Homo sapiens; identical to SEQ ID NO: 8509

SEQ ID NO: 27866 - DNA, 201 bp, Homo sapiens; identical to SEQ ID NO: 8510

SEQ ID NO: 27867 - DNA, 201 bp, Homo sapiens
ttgtcttctcctctgagcgggaactgggcaattggaggttctttcccctcccgtgctggtgggagaattgtttagtaggtcataaagtggaatctccattycagtctgatccggtcaattctggtaggacttcatccaagcacaaagaaacctttgttttcattcaagacttccctaaaaggtggctgggtgcggtgcctc

SEQ ID NO: 27868 - DNA, 201 bp, Homo sapiens
cagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcaca

SEQ ID NO: 27869 - DNA, 201 bp, Homo sapiens
ttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatg

SEQ ID NO: 27870 - DNA, 201 bp, Homo sapiens
ggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatacccagctaacttttgaatttttagtagagatggggtttca

SEQ ID NO: 27871 - DNA, 201 bp, Homo sapiens
caatggcatgatttctgctcactgcaacctccacctcctgggttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctc

SEQ ID NO: 27872 - DNA, 201 bp, Homo sapiens
atgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaag

SEQ ID NO: 27873 - DNA, 201 bp, Homo sapiens
cttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatat

SEQ ID NO: 27874 - DNA, 201 bp, Homo sapiens
ctttgccactcagccccagaggtgcttctgcttccctgcaggcttgccctggagcctggcgctagggccctggggctcccttgctcctgcgtgccccctgygcctgccttcctgctgcctggcctttctcccatctgctttcttcctgagtggcccctggccaggggactcgggtgcatacatggtttccaaacgcctttc

SEQ ID NO: 27875 - DNA, 201 bp, Homo sapiens
cccctgcgcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgtttttttttttttttttttttaatttaatttaacttta

SEQ ID NO: 27876 - DNA, 201 bp, Homo sapiens
ctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatg

SEQ ID NO: 27877 - DNA, 201 bp, Homo sapiens
taggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgc

SEQ ID NO: 27878 - DNA, 201 bp, Homo sapiens; identical to SEQ ID NO: 14751

SEQ ID NO: 27879 - DNA, 201 bp, Homo sapiens; identical to SEQ ID NO: 14752

SEQ ID NO: 27880 - DNA, 201 bp, Homo sapiens; identical to SEQ ID NO: 14753

SEQ ID NO: 27881 - DNA, 201 bp, Homo sapiens
caagcacctatcgttttcctgtgtattccaagaggccagtgtggctggtggaataagatgttttcctgttttcaagatgcagtggactctcttttatttarcagcagtgtctatgtgttaggaatccatgtgagttctctaagtctgggacaacgataggtgtgtctgagtcctgcattaccatggtttattctttccttt

SEQ ID NO: 27882 - DNA, 201 bp, Homo sapiens
ttaacttctttaaacctcagtttcttcatctgtaaaatgcacatcataatatctctattcagagatacaggtggttctattaaacacatcaactctgtgtwtataaagtcttaacccattgtggaataaattaagtgctcaattaaatgttagctgctgctattaataacaacaataataatattttcttcacgcatgaaa

SEQ ID NO: 27883 - DNA, 201 bp, Homo sapiens
ttgacactaaaagcttaagtcccatgatttgcctttgtggatggaaggccttggccttcttttatgatatatgtgttggggggaggcatgtggtatgtggrgcgggtaaaatacgagcctcatgcctgtctaagctggtgacttggcttggaaaagatgatcattcgtcaacgcatcacaagtcacagggcttatctccat

SEQ ID NO: 27884 - DNA, 201 bp, Homo sapiens
gaaggcctaggaggtgcagggatgtttatatgggctgctagcgcttagtttcctgccacagggagacagtaagaaaggtgacgtcaatctgagatgagagrgagagcaaaacagttcttttgaccaccttgaccccgaccttgaaataaggtggaactaataaatcccgctttgtgctggagcaagttttggctgagtttc

SEQ ID NO: 27885 - DNA, 201 bp, Homo sapiens
gccaccttttgccgcagtaacaaacaatcccagactctcaaggcttgcaaaaataaatgtgtgtttgtttgctcataacacatgtggctgagggttggccrtggctccacagtcacaggtgggctttcctgggctcagcttctcacagcgtctccttgcagggcccaggctgtaggagatgtcatcagggcctgcagaggg

SEQ ID NO: 27886 - DNA, 201 bp, Homo sapiens
caccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcc

SEQ ID NO: 27887 - DNA, 201 bp, Homo sapiens
tgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctcagtggcttgtcataggtgtcaaagacaggagtccaatgtaaggactt

SEQ ID NO: 27888 - DNA, 201 bp, Homo sapiens
ttatatgcctgttccatatgagaacattatgcatatggtgtgatttggtcattccggatggctaaagtgtgagcatacccgtatctcagatttacagaggwgaaaacagaggctcagactggttatgtatatttctctaagtcccccagctattgtttgttgtaggttgggtaccccaggaagtagattctgcaactgaga

SEQ ID NO: 27889 - DNA, 201 bp, Homo sapiens
attatatgcctgttccatatgagaacattatgcatatggtgtgatttggtcattccggatggctaaagtgtgagcatacccgtatctcagatttacagagragaaaacagaggctcagactggttatgtatatttctctaagtcccccagctattgtttgttgtaggttgggtaccccaggaagtagattctgcaactgag

SEQ ID NO: 27890 - DNA, 201 bp, Homo sapiens
gcttattgcctgctgcacattttagcctcatctcgttagtgcaagaaataatttaacaactgaaaaagatgtgaggttgtacctggtaaggtctctattgstcaaggaaaggtttagcatggagagatttctcttaaggtgcctaggtattcagaagcacccctaaaactgatttgtgtggccctatgcttacaagtggag

SEQ ID NO: 27891 - DNA, 201 bp, Homo sapiens
gtctggatatgaattccaaagaccactggactttggaatattcgtaggtctctgaaaattcagacccacagaggccttaccccgctacagagaggccccargagagaggcctcacaccctctggctccactgaaattcacttcacgtttccaacttggattaaactggcacgacagttcagtcaaatgtcaagtccatttt

SEQ ID NO: 27892 - DNA, 201 bp, Homo sapiens
aaaaaaaaaatcgggaattagcgtgtagctattaggcgtagattcctgcctaaggtctggatatgaattccaaagaccactggactttggaatattcgtargtctctgaaaattcagacccacagaggccttaccccgctacagagaggccccaagagagaggcctcacaccctctggctccactgaaattcacttcacgt

SEQ ID NO: 27893 - DNA, 201 bp, Homo sapiens
tggaaaaaaaaaatcgggaattagcgtgtagctattaggcgtagattcctgcctaaggtctggatatgaattccaaagaccactggactttggaatattcrtaggtctctgaaaattcagacccacagaggccttaccccgctacagagaggccccaagagagaggcctcacaccctctggctccactgaaattcacttca

SEQ ID NO: 27894 - DNA, 201 bp, Homo sapiens
gttcaagctggcctcgtgtttgtggttttagacacagctttgagtcgtgaccggtgtggccaagacctatttcccttgcaaatgctctctctcttttttcrgtaactgtgttactaaagttctcttagatactttacatttcctttcacggatttccaaaatttctttctttgagaatgtcaggaccagtaggaggttcag

SEQ ID NO: 27895 - DNA, 201 bp, Homo sapiens
cctttacattttaaagagggatgaggttgagtctgtccctagcactgacaatgaaacatttatgctgtttataaaaatcaggaaacacacaaataatttgmttaacgctcaccttctggtccttttgtgatttgagaggtcttgagataagaaaaactgtggatgaattttactgaactattgaattgagaatggctgagg

SEQ ID NO: 27896 - DNA, 201 bp, Homo sapiens
cccagcctgattcctgttttacatattaaaaatttcatctctccaatcttcgaagaatccgtagtccatttttaagtagctcttgtcttccaaaggtatgsgatgtgcctacctaatgctcttcctggatgggagaatattaccaaaaacgtttggtcgactaattttatgacagtttccaactacaatttttttcctctt

SEQ ID NO: 27897 - DNA, 201 bp, Homo sapiens
tattcctcgcctggcctcattgctcgcttcgtttcggaggaaattttccctgttaaagtactgtacttgtcatttatttcccttttttccactctccctcygtggctgggtttggatatgcatttatccaaaaggcaaggcttttacacacttccgctaacctcttatggtcaggctcataaaagcaacccaacaaagctt

SEQ ID NO: 27898 - DNA, 201 bp, Homo sapiens
gggtgtgagagtggcacattccacaggaagggaaccctgcatgtccatgtgccatgtgccatgtgccatcttagagacgtaaaaacactttgtatgtttgsggtacaactcagtaacccattggtgcagatatgtgattcttaggatggcccacatgggtctctttcacacacccacgtgcatgacccaagtgagcaaaca

SEQ ID NO: 27899 - DNA, 201 bp, Homo sapiens
ctccaggctgtgtgacagagcaagaccccatctctaaataagtaaataaatgcctctgtgaatccatttcattgcattggaaagacctccaggattctctscagaagaatctttcccaacataaaatccattgttaatcacatttgacacacatgtgtgcccatgtctctgggcctgtgtccataggcatctacgtcactg

SEQ ID NO: 27900 - DNA, 201 bp, Homo sapiens
aaggctgcagtgaaccatgatggtgccactgcactccaggctgtgtgacagagcaagaccccatctctaaataagtaaataaatgcctctgtgaatccatytcattgcattggaaagacctccaggattctctgcagaagaatctttcccaacataaaatccattgttaatcacatttgacacacatgtgtgcccatgtct

SEQ ID NO: 27901 - DNA, 201 bp, Homo sapiens
ggcaggaagattgcttgagcctgggacgtcaaggctgcagtgaaccatgatggtgccactgcactccaggctgtgtgacagagcaagaccccatctctaartaagtaaataaatgcctctgtgaatccatttcattgcattggaaagacctccaggattctctgcagaagaatctttcccaacataaaatccattgttaat

SEQ ID NO: 27902 - DNA, 201 bp, Homo sapiens
actctgggaggccaagatgagaggatcacttgagcctagaagtttgagaccagtcagggcaatatagactacctgcaaaaagaaaaaaaaaaaaatgccakgtgtagtggtgtgcgcctgtagtcccagctactcagggggctgaggcaggaagattgcttgagcctgggacgtcaaggctgcagtgaaccatgatggtgc

SEQ ID NO: 27903 - DNA, 201 bp, Homo sapiens
attatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattca

SEQ ID NO: 27904 - DNA, 201 bp, Homo sapiens
ctaaattatgccagattaagaaaatgaaatctgactgtaaattacttctctaggagcaaatgattgcttgattctattgtagaaaataaaaattttttacytaaaccacacaaattaaaaaatggaactcactttcacagtcaagagttacttctatttttttttacagtaaatgcgctctttaagatgttgcaagctcaa

SEQ ID NO: 27905 - DNA, 201 bp, Homo sapiens
gaagtatcacttatcctacgttccatgtaagatctctttcctagggtaaacttgatatggaaggtcttcacagattaaaacgaaggaaaaaaaaaaaaaaactagataaatctccctggacatgaacttttgtagaagtagttacaacgctagtgacctcatatactcatggtaacggcttccggcatccaatgaccttgc

SEQ ID NO: 27906 - DNA, 201 bp, Homo sapiens
agctgcaggatcacttgctttagatggaatcacccagcggatggcgtttaactctgctttaaaccccttcatggcttcccaccacacttacaaatacaachccttatcctgtcagcaggggcttgcttaatctgaccctttccacatatgctggatcacttcacgcctccctgttctttcaattccttgaacacaccaagt

SEQ ID NO: 27907 - DNA, 201 bp, Homo sapiens
gctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaac

SEQ ID NO: 27908 - DNA, 201 bp, Homo sapiens
cactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgt

SEQ ID NO: 27909 - DNA, 201 bp, Homo sapiens
acatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgca

SEQ ID NO: 27910 - DNA, 201 bp, Homo sapiens
aaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggct

SEQ ID NO: 27911 - DNA, 201 bp, Homo sapiens
aaagatagtgtgcatgcctcatctctaaggggcagccattattgacgtccagctgaatgttgccacgtggaaattagctataaacttgccagaacctccartttttctggagagattagattagaaattcatatatttttaaatattaaatcatccctttttcttgagatggtgtcacgtcgttgcccaggccaccgttta

SEQ ID NO: 27912 - DNA, 201 bp, Homo sapiens
gctaaatctatgtccccaatatagggaagacaggagaaagtgccaaagatagtgtgcatgcctcatctctaaggggcagccattattgacgtccagctgartgttgccacgtggaaattagctataaacttgccagaacctccagtttttctggagagattagattagaaattcatatatttttaaatattaaatcatccc

SEQ ID NO: 27913 - DNA, 201 bp, Homo sapiens
gccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattatt

SEQ ID NO: 27914 - DNA, 201 bp, Homo sapiens
cctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgctt

SEQ ID NO: 27915 - DNA, 201 bp, Homo sapiens
tcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaata

SEQ ID NO: 27916 - DNA, 201 bp, Homo sapiens
ctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctc

SEQ ID NO: 27917 - DNA, 201 bp, Homo sapiens
ctttattattttaatggagtgcaaggtgcagtctttttgaagatgtagaatgtggccttataaaagctaagtgctactttatatttctgctgtccttgccsgtggcctgcactggggagttgtatattgtatcagtaattttaaaagccagcaagtgttctaccagctgaagaagttttcctaatggtggctggtcaaacg

SEQ ID NO: 27918 - DNA, 201 bp, Homo sapiens
ttcattctgtttctttattattttaatggagtgcaaggtgcagtctttttgaagatgtagaatgtggccttataaaagctaagtgctactttatatttctrctgtccttgccggtggcctgcactggggagttgtatattgtatcagtaattttaaaagccagcaagtgttctaccagctgaagaagttttcctaatggtg

SEQ ID NO: 27919 - DNA, 201 bp, Homo sapiens
ttataagttacattttacataaaaaggcagcagtggtgaagctggaagagggcacctaggctttgatttcaggcaagattttgttaggtcccagtattggracttccggttggtggattttgctcaagaatagttttctctttgtctaacgcttcatgagagacaacctaaataaagccacagccagtgttacagaaatag

SEQ ID NO: 27920 - DNA, 201 bp, Homo sapiens
caatcatatttaaatcattgctgctggaactttagttgactttataagttacattttacataaaaaggcagcagtggtgaagctggaagagggcacctagrctttgatttcaggcaagattttgttaggtcccagtattgggacttccggttggtggattttgctcaagaatagttttctctttgtctaacgcttcatgag

SEQ ID NO: 27921 - DNA, 201 bp, Homo sapiens
aaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaa

SEQ ID NO: 27922 - DNA, 201 bp, Homo sapiens
tgatgattaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacatt

SEQ ID NO: 27923 - DNA, 201 bp, Homo sapiens
atggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtc

SEQ ID NO: 27924 - DNA, 201 bp, Homo sapiens
atgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacag

SEQ ID NO: 27925 - DNA, 201 bp, Homo sapiens
agccccagtaaccctaagattgaacaaaaccctacttacgtgctacggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccac

SEQ ID NO: 27926 - DNA, 201 bp, Homo sapiens
atcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagcattaattccttacaaccctgatgggtcccagctgtgcacacgca

SEQ ID NO: 27927 - DNA, 201 bp, Homo sapiens
ccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatc

SEQ ID NO: 27928 - DNA, 201 bp, Homo sapiens
cagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatga

SEQ ID NO: 27929 - DNA, 201 bp, Homo sapiens
tgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtat

SEQ ID NO: 27930 - DNA, 201 bp, Homo sapiens
tggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttt

SEQ ID NO: 27931 - DNA, 201 bp, Homo sapiens
ggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgta

SEQ ID NO: 27932 - DNA, 201 bp, Homo sapiens
aggatcgcttgcatccaggaggttgaggctgcagtgagccatgactgtggcactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgt

SEQ ID NO: 27933 - DNA, 201 bp, Homo sapiens
tagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaaagcagtatagtcagtaagaaagaaaacaaactaacagtcaatattgtgg

SEQ ID NO: 27934 - DNA, 201 bp, Homo sapiens
cattatggtacataaaagagctttctatcgcttttttacattatagtagttattcgttattattattattattattattattattattattattattattwctgagacaccgttttactctctctttgcccaggctggagtgaaatggcacgatcgcagctcactgcgacctccacctcttgggttcaagtggttcttctg

SEQ ID NO: 27935 - DNA, 201 bp, Homo sapiens
agtaggagatatatcttacttaaaaaaaaaaaaaacaaacaaacaaaaaaaaaaaactccttcttcatttgttatagttccaggatagagtgtgtacctgkatagagagagtcaggcagatacaggtgtgccctccttccaagatgtgtgatggtgggcaactttctttgcatctctgagcctctattttctctatataaa

SEQ ID NO: 27936 - DNA, 201 bp, Homo sapiens
agaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctg

SEQ ID NO: 27937 - DNA, 201 bp, Homo sapiens
ctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcc

SEQ ID NO: 27938 - DNA, 201 bp, Homo sapiens
tttgggctgttattaggtagactctcctgggacattctacacagctcctgcctccttctgtatgtaatatatatattatatatatataaaatatatattakgtatagataatttatatataaatatgtgtatatatatatttgttagggtaaaacaaagtctataaaaactgttttcctttgtcattgcccccaccaaata

SEQ ID NO: 27939 - DNA, 201 bp, Homo sapiens
gaaagagagggaactgaacgggatgctttttattttgggctgttattaggtagactctcctgggacattctacacagctcctgcctccttctgtatgtaayatatatattatatatatataaaatatatattatgtatagataatttatatataaatatgtgtatatatatatttgttagggtaaaacaaagtctataaaa

SEQ ID NO: 27940 - DNA, 201 bp, Homo sapiens
taaatagtggatgtattttttctagtttttttgttttgcttaataggctctctctctgtctctttctttctatatatatatataatatatagaaagatatrtaatctatatatagatatctatataatatatataatctatatatgatatatatatcttattatatattatatatatagatagatatctatatacagatat

SEQ ID NO: 27941 - DNA, 201 bp, Homo sapiens
atgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctcc

SEQ ID NO: 27942 - DNA, 201 bp, Homo sapiens
ccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagg

SEQ ID NO: 27943 - DNA, 201 bp, Homo sapiens
cgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataag

SEQ ID NO: 27944 - DNA, 201 bp, Homo sapiens
ccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacc

SEQ ID NO: 27945 - DNA, 201 bp, Homo sapiens
aaagcacacacaatgatggccagagacactgctcagtgtactgtcttccaccgggacagcccactcaccaagggttaggtcctgtgctgactgggtcccgkgtctcctcggaggtcggtttgcatcacgtggatacactaatctacccaagttgacttggagaaccaatctgaaatcagatgggagctcccggaagcaaag

SEQ ID NO: 27946 - DNA, 201 bp, Homo sapiens
tgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaa

SEQ ID NO: 27947 - DNA, 201 bp, Homo sapiens
ccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccaga

SEQ ID NO: 27948 - DNA, 201 bp, Homo sapiens
agtttgtcttggctctgatcacccctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgcccctt

SEQ ID NO: 27949 - DNA, 201 bp, Homo sapiens
agagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgt

SEQ ID NO: 27950 - DNA, 201 bp, Homo sapiens
tacagtggctcatgtctgtaattctagcactttgggaggccggggcgagcaaattgcttgaactcaggagttcgaggctagcctgggcaacacggcaaagscctcatctctacaaaaaatacaaaaattagctgggcttggtgacagacgcttgtagtctcagctactcgggaggctgaagtgggaggatctttagagccc

SEQ ID NO: 27951 - DNA, 201 bp, Homo sapiens
cagatggagggaaagagaggcgggggattccaggtacagtggctcatgtctgtaattctagcactttgggaggccggggcgagcaaattgcttgaactcasgagttcgaggctagcctgggcaacacggcaaagccctcatctctacaaaaaatacaaaaattagctgggcttggtgacagacgcttgtagtctcagctac

SEQ ID NO: 27952 - DNA, 201 bp, Homo sapiens
gagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcagg

SEQ ID NO: 27953 - DNA, 201 bp, Homo sapiens
cgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccagga

SEQ ID NO: 27954 - DNA, 201 bp, Homo sapiens
ccatgtggcacatacccctgtacatgtttgccaagactgctatatggtagagcttggaattcttaggagctttatcaggtaattgcaagtcccccacctcyaagaaagcactctctaggtcaagaatcagcaaatgttttctatagaggcccgtaaaattaatattttatactttgtgggtcatatagtctctgtttcaat

SEQ ID NO: 27955 - DNA, 201 bp, Homo sapiens
gaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctg

SEQ ID NO: 27956 - DNA, 201 bp, Homo sapiens
gcagtctgattgtgcgacagaaaagaaaaacccattttctggggagaaattcaagctggctgcagaaatttgtgtaagtggcaaggaacctaatgttaatstcgaagaccatgaggaaaatgtctccaggccatgtcagagactttcacagcagcccctcctatcagaggcctgaagtcccaggaggaaaaaatgatttca

SEQ ID NO: 27957 - DNA, 201 bp, Homo sapiens
aagcagagcatcaaggtttggaaaatttgcagtctgattgtgcgacagaaaagaaaaacccattttctggggagaaattcaagctggctgcagaaatttgkgtaagtggcaaggaacctaatgttaatctcgaagaccatgaggaaaatgtctccaggccatgtcagagactttcacagcagcccctcctatcagaggcct

SEQ ID NO: 27958 - DNA, 201 bp, Homo sapiens
aagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgtgtaagtggcaaggaacctaatgttaatctcgaagaccatgaggaaaatgtctcca

SEQ ID NO: 27959 - DNA, 201 bp, Homo sapiens
agcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgt

SEQ ID NO: 27960 - DNA, 201 bp, Homo sapiens
ttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttct

SEQ ID NO: 27961 - DNA, 201 bp, Homo sapiens
tataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctc

SEQ ID NO: 27962 - DNA, 201 bp, Homo sapiens
catgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaa

SEQ ID NO: 27963 - DNA, 201 bp, Homo sapiens
actccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctagg

SEQ ID NO: 27964 - DNA, 201 bp, Homo sapiens
tgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactc

SEQ ID NO: 27965 - DNA, 201 bp, Homo sapiens
tctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttcct

SEQ ID NO: 27966 - DNA, 201 bp, Homo sapiens
catccttcatcaaggtgacataggtctggcgatctttttggcatagacgtgtggacgttgtttttgacatttgtacatgcttttgctcaagttgaaggccsaagtttacccaattcgactgcccccacccagatagaatattcatggttagaccataaactacataactggaaattttaaatctatttttatatgcataca

SEQ ID NO: 27967 - DNA, 201 bp, Homo sapiens
gaactcctagcctcaagtgatccgccagcctcagcctcccaaagtgctgggatcacaggcataggctgctgcaccaggcaaggacttttttttttttttttaaacaaacttcactcagtttgaaggcaccattatttgggtttcctgttaattgcagttaatcctattgagtaaatgtatcaaggacaaagagcagaatga

SEQ ID NO: 27968 - DNA, 201 bp, Homo sapiens
taggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagc

SEQ ID NO: 27969 - DNA, 200 bp, Homo sapiens
gtccagtatattggcctccagggcaaagctacctaggttctgagtccaattatggccttcatgagtcttgtttctttggacaggttttccagtgtctctggcctcaacttcctcatgtataaagtggagatgatgccattacaggttgctgctttatggcacataattaatactagctcttatttataggaactgaacaa

SEQ ID NO: 27970 - DNA, 201 bp, Homo sapiens
tgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtca

SEQ ID NO: 27971 - DNA, 201 bp, Homo sapiens
tttcttaccaggagtacatagtttgttctttaagcaaaaccatatgcatcgtattttaaatggaacagggaggttgttccatgcgtcaacttagtccaaawgtagagggtcaggaaaacaatgatatgagaaaagggccggttactgtctgggaatccataaatactgcttggcaaatggcacattgcatgcttattcctt

SEQ ID NO: 27972 - DNA, 201 bp, Homo sapiens
gtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctga

SEQ ID NO: 27973 - DNA, 201 bp, Homo sapiens; identical to SEQ ID NO: 4864

SEQ ID NO: 27974 - DNA, 201 bp, Homo sapiens
catagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctct

SEQ ID NO: 27975 - DNA, 201 bp, Homo sapiens
attctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttga

SEQ ID NO: 27976 - DNA, 201 bp, Homo sapiens
tatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgaga

SEQ ID NO: 27977 - DNA, 201 bp, Homo sapiens
taaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacataca

SEQ ID NO: 27978 - DNA, 201 bp, Homo sapiens
gtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctgg

SEQ ID NO: 27979 - DNA, 201 bp, Homo sapiens
agaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcat

SEQ ID NO: 27980 - DNA, 201 bp, Homo sapiens
cttctctttgcgtcaccagagaggaagatcccctaagacaaagcattccctgtagtttttagcataactagtactggctcagtaagtatccactggggttsggaatacaactgccctgcctcttgagcagccatgcctgcttccgaggtggtgctgcatgctattcaggaggacagaccatggatgggaatcctgagccac

SEQ ID NO: 27981 - DNA, 201 bp, Homo sapiens
gtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatg

SEQ ID NO: 27982 - DNA, 201 bp, Homo sapiens
ctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgc

SEQ ID NO: 27983 - DNA, 201 bp, Homo sapiens
tcttagaatcttctgaaataatatgcagcattatattccatttgtacctgggaagagggtacttgtctttcatcagagagtcaccaatggaccactggtcyctgctgatttagtgtcacagctcaaaaccatcagtagtcctcgtgatctttcggcattgtggctccctttgtgagaagggcctaagagtgaatctcccaa

SEQ ID NO: 27984 - DNA, 201 bp, Homo sapiens
ctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacagg

SEQ ID NO: 27985 - DNA, 201 bp, Homo sapiens
tatgtagtcatatatatatatgtgtgtgtgtgtgtgtgtatgtatatatatgtgtgtgtatgtatatatatgtatgtatctgtatatgtataatggctgtmcatgatataattttgagttggaaaaagcaaattgaagaataatacatgtattatcatgtctttaaaaaaaaactatacacatagctgaatgtttttgtgt

SEQ ID NO: 27986 - DNA, 201 bp, Homo sapiens
atatgtagtcatatatatatatgtgtgtgtgtgtgtgtgtatgtatatatatgtgtgtgtatgtatatatatgtatgtatctgtatatgtataatggctgkacatgatataattttgagttggaaaaagcaaattgaagaataatacatgtattatcatgtctttaaaaaaaaactatacacatagctgaatgtttttgtg

SEQ ID NO: 27987 - DNA, 201 bp, Homo sapiens
tctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgatt

SEQ ID NO: 27988 - DNA, 201 bp, Homo sapiens
gtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatgg

SEQ ID NO: 27989 - DNA, 201 bp, Homo sapiens
agggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggc

SEQ ID NO: 27990 - DNA, 201 bp, Homo sapiens
ttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctac

SEQ ID NO: 27991 - DNA, 201 bp, Homo sapiens
ggcggagcttgcagtgagcggagatcgtgacactgcactccggcctgggtgacagagcctgaatccctctcaaaaaaaaaaaaaaaagaaagaaaacaacyacaaccacattttgagataggccttccttggcaaactttgatttcgtttctgtatttgaggacaaaacacagtatggttgtttccctccctagactagat

SEQ ID NO: 27992 - DNA, 201 bp, Homo sapiens
cgtgaacccgggaggcggagcttgcagtgagcggagatcgtgacactgcactccggcctgggtgacagagcctgaatccctctcaaaaaaaaaaaaaaaaraaagaaaacaaccacaaccacattttgagataggccttccttggcaaactttgatttcgtttctgtatttgaggacaaaacacagtatggttgtttccct

SEQ ID NO: 27993 - DNA, 201 bp, Homo sapiens
gagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagca

SEQ ID NO: 27994 - DNA, 201 bp, Homo sapiens
ctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttgg

SEQ ID NO: 27995 - DNA, 201 bp, Homo sapiens
ccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtga

SEQ ID NO: 27996 - DNA, 201 bp, Homo sapiens
ggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaa

SEQ ID NO: 27997 - DNA, 201 bp, Homo sapiens
tcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttatacaatatttcttttgaaacgagg

SEQ ID NO: 27998 - DNA, 201 bp, Homo sapiens
tcttacacagtttgtaagtcttaaaactcagtatctactctagtagttgctccaaatgtgatgtcctcataaatcaccgagggatcttgttaaatttggaytctgattcagtaggtctaggtggggcccgagcttctttgtttccttttcttatttaatttttgtgggtacctagtaggtgtgtatgtacatatatatgta

SEQ ID NO: 27999 - DNA, 201 bp, Homo sapiens
gtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtctt

SEQ ID NO: 28000 - DNA, 201 bp, Homo sapiens
gaccttgtatgcacacatgagaatttagagatctatatataccgcctggcctcttctttgtaagggtataacagcagtggttaacatgcatttttttttttaacagttagatttactcttcctttgcacagactaatagcacactgaggtaggatccagggacggctccttggcaagttgtactgctgtggcctagggagg

SEQ ID NO: 28001 - DNA, 201 bp, Homo sapiens
aacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattat

SEQ ID NO: 28002 - DNA, 201 bp, Homo sapiens
tcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgact

SEQ ID NO: 28003 - DNA, 201 bp, Homo sapiens
gggaggccaaggtgggtgggtcacctgaggtcaggacttcgagaccagcctggccaacatggtgaaaccgcatctctactaaaaataaaaaaaaaaaaaaattagccaggcatggtggtgcatgtctgttatcccagctacttgggaggctaaggcaggagaatcacttgaacctgggaggcagcggttgcagtgagccga

SEQ ID NO: 28004 - DNA, 201 bp, Homo sapiens
agctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcgccctcactaataaattctg

SEQ ID NO: 28005 - DNA, 201 bp, Homo sapiens
cttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacag

SEQ ID NO: 28006 - DNA, 201 bp, Homo sapiens
caacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctcttttt

SEQ ID NO: 28007 - DNA, 201 bp, Homo sapiens
attataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgcttt

SEQ ID NO: 28008 - DNA, 201 bp, Homo sapiens
tatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatac

SEQ ID NO: 28009 - DNA, 201 bp, Homo sapiens
ttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggcca

SEQ ID NO: 28010 - DNA, 201 bp, Homo sapiens
ttctaaatactctcccagagtagggaggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctt

SEQ ID NO: 28011 - DNA, 201 bp, Homo sapiens
ctgagtagctgggactacaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaag

SEQ ID NO: 28012 - DNA, 201 bp, Homo sapiens
agtaagcacagtggctgggataggaccttggcatctcgtgcgaagcccctctgcctggagtcctgcctctgtgacacttgcttactgtgtgacctgggtcractcatacctactgttcgtcagttttctcatctgtaaaatggggattccagtggttattatgagaattaaatatgacgatacataaatagcacctggaaa

SEQ ID NO: 28013 - DNA, 201 bp, Homo sapiens
ttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcc

SEQ ID NO: 28014 - DNA, 201 bp, Homo sapiens
agaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcat

SEQ ID NO: 28015 - DNA, 201 bp, Homo sapiens
tggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcag

SEQ ID NO: 28016 - DNA, 201 bp, Homo sapiens
gatagtaggtaaattaatggaggaagggagtcaactaaacaatttatttgagcaattaatggaggaagggagtcaactaaacaatttattagggctttatktaaagccctagggttagttggttggttggttttgttttgttttgttcctttttttttttgccaggggatgctgtggttgaatttccctctgtggtgagag

SEQ ID NO: 28017 - DNA, 201 bp, Homo sapiens
gtttatgccactgcaacattttagaatcacctgggaagcttttgaaaactcccagcatcatgaagcatggtctcttgccttggggtcagtgtctgtcaacrtggcttttgctaaagagccttcccctatgagaagtgaggcaggagaaggcggagtgaccacaagatgccctgatggtgccaagctattattataaatgaa

SEQ ID NO: 28018 - DNA, 201 bp, Homo sapiens
agtttatgccactgcaacattttagaatcacctgggaagcttttgaaaactcccagcatcatgaagcatggtctcttgccttggggtcagtgtctgtcaaygtggcttttgctaaagagccttcccctatgagaagtgaggcaggagaaggcggagtgaccacaagatgccctgatggtgccaagctattattataaatga

SEQ ID NO: 28019 - DNA, 201 bp, Homo sapiens
gtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgttta

SEQ ID NO: 28020 - DNA, 201 bp, Homo sapiens
tggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgt

SEQ ID NO: 28021 - DNA, 201 bp, Homo sapiens
ctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaa

SEQ ID NO: 28022 - DNA, 201 bp, Homo sapiens
tattgatctagactgcctgctactttcatttaccatgttactgctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaa

SEQ ID NO: 28023 - DNA, 201 bp, Homo sapiens
tgcctaccaccatgtttctgaggcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcctaaggttttattaatat

SEQ ID NO: 28024 - DNA, 201 bp, Homo sapiens
cgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattaga

SEQ ID NO: 28025 - DNA, 201 bp, Homo sapiens
ttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctct

SEQ ID NO: 28026 - DNA, 201 bp, Homo sapiens
acagtcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatc

SEQ ID NO: 28027 - DNA, 201 bp, Homo sapiens
agatacaagaaggccacatgtggtggttcacccctgtaatcccagcagtctgtgagactgaggcagaaggattgcttgagaagtttgagattggcctgggmaatatagcaagatcccaaccctattaaaaaattaaaaatgaaaataaaattttaaagaaaggtatttctccccttcacggtaatttggagccaatacttc

SEQ ID NO: 28028 - DNA, 201 bp, Homo sapiens
tggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtccc

SEQ ID NO: 28029 - DNA, 201 bp, Homo sapiens
ttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacat

SEQ ID NO: 28030 - DNA, 201 bp, Homo sapiens
gactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagt

SEQ ID NO: 28031 - DNA, 201 bp, Homo sapiens
ggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatgg

SEQ ID NO: 28032 - DNA, 201 bp, Homo sapiens
gctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattca

SEQ ID NO: 28033 - DNA, 201 bp, Homo sapiens
tgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagcctttaaaagaaccaactctctgggaacaaatagagggagaacattaatctagccatga

SEQ ID NO: 28034 - DNA, 201 bp, Homo sapiens
gacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacaca

SEQ ID NO: 28035 - DNA, 201 bp, Homo sapiens
agaattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgt

SEQ ID NO: 28036 - DNA, 201 bp, Homo sapiens
taagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagatt

SEQ ID NO: 28037 - DNA, 201 bp, Homo sapiens
agatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagc

SEQ ID NO: 28038 - DNA, 201 bp, Homo sapiens
attattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttg

SEQ ID NO: 28039 - DNA, 201 bp, Homo sapiens
acagttgtattcctaagacatagttgggaccagacctcaagaaaatagccaacaaatactggctgaatgaacgaaagaggccatatgcagtcagcccccctctctctgggttctacatatgtagatttaactaatgacagattaaaagcattcgaacaaacggagggtggtatctgtactgaaaatgtaccaactgctttt

SEQ ID NO: 28040 - DNA, 201 bp, Homo sapiens
taagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagc

SEQ ID NO: 28041 - DNA, 201 bp, Homo sapiens
cttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggt

SEQ ID NO: 28042 - DNA, 201 bp, Homo sapiens
ttactttgcaggattgctgtaaggattagaaccaccgtctctaaggcattcagcatagtcccttagggtaacatgagtgctcaagaaatagtaaattttartatgtgtctcatttttttccagatgctctggggtcactaccaaccttgcctttcaccctacctgtggatctatgaccctgtccttctcagaacaccactc

SEQ ID NO: 28043 - DNA, 201 bp, Homo sapiens
tttcacctacaaaatgaaggctacaatatttactttgcaggattgctgtaaggattagaaccaccgtctctaaggcattcagcatagtcccttagggtaamatgagtgctcaagaaatagtaaattttagtatgtgtctcatttttttccagatgctctggggtcactaccaaccttgcctttcaccctacctgtggatct

SEQ ID NO: 28044 - DNA, 201 bp, Homo sapiens
tgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagt

SEQ ID NO: 28045 - DNA, 201 bp, Homo sapiens
ttcataatcagcagaagtcttttctctggaaggaacaaaggattaagttagggagacagtaatggtattgttagcaggctatttcaatgattttctctgcrgaagagtagggaaaggtgacattccaactgggaatattcgactctgcagatccctactcggagtttttcagccctgttttaagtgccgagctgggttttg

SEQ ID NO: 28046 - DNA, 201 bp, Homo sapiens
cattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgt

SEQ ID NO: 28047 - DNA, 201 bp, Homo sapiens
agccatactcagagtggccctaggatggctcctcagatagctgctggcagaaacctgcactcagtacatctatacatggtgtaatgattgactcaagatamttagcatagccatcatctcaaacctttattatttgtgatgagaagattcaaaacccgctttttgaactgttctgaaatatgcaataccttgttgttaact

SEQ ID NO: 28048 - DNA, 201 bp, Homo sapiens
tcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcac

SEQ ID NO: 28049 - DNA, 201 bp, Homo sapiens
tccgctcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatca

SEQ ID NO: 28050 - DNA, 201 bp, Homo sapiens
atccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatc

SEQ ID NO: 28051 - DNA, 201 bp, Homo sapiens
gtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattata

SEQ ID NO: 28052 - DNA, 201 bp, Homo sapiens
tagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggttt

SEQ ID NO: 28053 - DNA, 201 bp, Homo sapiens
ccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaac

SEQ ID NO: 28054 - DNA, 201 bp, Homo sapiens
gttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcct

SEQ ID NO: 28055 - DNA, 201 bp, Homo sapiens
ggtggaggttgcagtgagctgagatcacaccactgcactccagcctgggtgacagagcaagactgtctcaaaaaaaaaaaaaaaaaaaaaaaaattcaacwtacgaattttgcgaggacgcaaacatttaatccgtagtactgatgtggatatgatttgagctaagactctgctgttgattctcttcaaaaacttggcagt

SEQ ID NO: 28056 - DNA, 201 bp, Homo sapiens
tttcacagtgtttctagctcccctttccaatacatctctctctctctttctctctctctctctctctctctcacacacacacacacacacacacacacacmgccaaatcagacaccaacataaactgtagagttaacattctttttccaccctcacactttttttagctccgatctgtgttcaatttctgcctgagagagt

SEQ ID NO: 28057 - DNA, 201 bp, Homo sapiens
gcatttatctttgatgctgggaatgcgttcattttctttatcttgccattactgtacctctattgggaaatttactctctcttcatagataggatccgathcagtacatatttataaaaccacacttacatttaaatacaggcctttcccatttcacagtgtttctagctcccctttccaatacatctctctctctctttc

SEQ ID NO: 28058 - DNA, 201 bp, Homo sapiens
ggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatgggg

SEQ ID NO: 28059 - DNA, 201 bp, Homo sapiens
atagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaac

SEQ ID NO: 28060 - DNA, 201 bp, Homo sapiens
acctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctact

SEQ ID NO: 28061 - DNA, 201 bp, Homo sapiens
acatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccagcctgggcaaaaagagcggggtaaaaaaacaacaaaaaaatgatgt

SEQ ID NO: 28062 - DNA, 201 bp, Homo sapiens
gagggtggcagtgatcttgaggggggtctgggagggaggagccagcctggcctggtctggcctggcccagtgtgccagctagggcaggtgcaatggctcaygcctataatcccagcactttgggaggccgaggcaggtggatcacctgaggtcaggagttcaagaccagcctgaccaacatggtgaaaccccatctctact

SEQ ID NO: 28063 - DNA, 201 bp, Homo sapiens
cctgcttaggaaatttgggttgagggtggcagtgatcttgaggggggtctgggagggaggagccagcctggcctggtctggcctggcccagtgtgccagckagggcaggtgcaatggctcacgcctataatcccagcactttgggaggccgaggcaggtggatcacctgaggtcaggagttcaagaccagcctgaccaaca

SEQ ID NO: 28064 - DNA, 201 bp, Homo sapiens
cctagagcaggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggca

SEQ ID NO: 28065 - DNA, 201 bp, Homo sapiens
agaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcaggttgggcaagaggcttttctctcagtcaccagccccaaaccctgtggt

SEQ ID NO: 28066 - DNA, 201 bp, Homo sapiens
caggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgta

SEQ ID NO: 28067 - DNA, 201 bp, Homo sapiens
catgatctcggctcactgcaagctctgcctcctaggctcatgccattctcctccctcagcctcctgagtagctgggactgcaggcgccagccaccacgccyggctaattttttatatttttagtagagacggggtttcaccatgctaaccaggatggtctcgatctcctgacctcgtgatccaccagccttggcctcccaa

SEQ ID NO: 28068 - DNA, 201 bp, Homo sapiens
tcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgcccggctaattttttatatttttagtagagacggggtttca

SEQ ID NO: 28069 - DNA, 201 bp, Homo sapiens
tctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccat

SEQ ID NO: 28070 - DNA, 201 bp, Homo sapiens
gggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgc

SEQ ID NO: 28071 - DNA, 201 bp, Homo sapiens
tcaggtgggactcatggagattttccgttctttggagactagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccct

SEQ ID NO: 28072 - DNA, 201 bp, Homo sapiens
gtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaac

SEQ ID NO: 28073 - DNA, 201 bp, Homo sapiens
gtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccgtctgaca

SEQ ID NO: 28074 - DNA, 201 bp, Homo sapiens
cccagcctgggggagggtttgttaaagaactgtctgttttatcacatgaccacaagttaaaatgttgggcaatgtccctgaatgataccttttcattagtractcacatggacccataatctctgaatttaacatgcttttcaggaatgtgttcatattttccacctataaaacctgttttagtaatttactcccttgtaa

SEQ ID NO: 28075 - DNA, 201 bp, Homo sapiens
gatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcc

SEQ ID NO: 28076 - DNA, 201 bp, Homo sapiens
ggagtaggaggctgcagtaagctgagatcatgccactgcactccagcctgggttaacagagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatg

SEQ ID NO: 28077 - DNA, 201 bp, Homo sapiens
cagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaaatcaaaattgatgcaaaaaatatgataacatttcaaaatttaaatcaagacaaattcaa

SEQ ID NO: 28078 - DNA, 201 bp, Homo sapiens
aggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggcca

SEQ ID NO: 28079 - DNA, 201 bp, Homo sapiens
ccacttcctggaggactgtcagtgctagctaatgagactgtaaaagtggactatctgcccaggagacagtgaggaaggaaatcaggggtcacccttacagsgaagggctctttgcagagagagtgcctgatacgtagcagctggtacttctccatcttgaaactgtccttcctggttttgtctaatttgtcatcatgggat

SEQ ID NO: 28080 - DNA, 201 bp, Homo sapiens
ttgccacttcctggaggactgtcagtgctagctaatgagactgtaaaagtggactatctgcccaggagacagtgaggaaggaaatcaggggtcacccttayagggaagggctctttgcagagagagtgcctgatacgtagcagctggtacttctccatcttgaaactgtccttcctggttttgtctaatttgtcatcatgg

SEQ ID NO: 28081 - DNA, 201 bp, Homo sapiens
ctcagacagataagaagctggcccacccttgccacttcctggaggactgtcagtgctagctaatgagactgtaaaagtggactatctgcccaggagacagygaggaaggaaatcaggggtcacccttacagggaagggctctttgcagagagagtgcctgatacgtagcagctggtacttctccatcttgaaactgtcctt

SEQ ID NO: 28082 - DNA, 201 bp, Homo sapiens
aaaatagagtcagcagcatctaaagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagtgaggaaggaaa

SEQ ID NO: 28083 - DNA, 201 bp, Homo sapiens
aatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagataagaagctggcccacccttgcc

SEQ ID NO: 28084 - DNA, 201 bp, Homo sapiens
agtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgt

SEQ ID NO: 28085 - DNA, 201 bp, Homo sapiens
acctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctt

SEQ ID NO: 28086 - DNA, 201 bp, Homo sapiens
agggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttttttgttttgtt

SEQ ID NO: 28087 - DNA, 201 bp, Homo sapiens
ctgtcaaacaacacagtccccatctgtactttgggagggaaggacttcttaattccagctgcctgttgccatgggggaacatagacccagaactgccatcytttctaatttttttaaaaattagaggctaaaagttttggcttataaaaatggtatttcctgagtttttacaattatagtattaagatattcctaggtttt

SEQ ID NO: 28088 - DNA, 201 bp, Homo sapiens
gttttcgagacgaagtttcgctctcatttcccaggatggagtgcagtggtgcaatctcctccgcctcccagtttaagccattctcctgcctcagcctcctragtagctgggattacaggcgcccgccaccatgcccggctaattttttgtattttttagtacagacggggtttcagcatgttggccaggctggtctcaaac

SEQ ID NO: 28089 - DNA, 201 bp, Homo sapiens
gacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaa

SEQ ID NO: 28090 - DNA, 201 bp, Homo sapiens; identical to SEQ ID NO: 14754

SEQ ID NO: 28091 - DNA, 201 bp, Homo sapiens; identical to SEQ ID NO: 14755

SEQ ID NO: 28092 - DNA, 201 bp, Homo sapiens
atataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaa

SEQ ID NO: 28093 - DNA, 201 bp, Homo sapiens
gcagaaaggtgcctatcatgtcttcagtgtcagtgccctggtatggagctagctggccttccacaggttctggagttaatgctggagagaagtaggggtgkcagagcctaccctgtgttcctaggggggttcatctggagctagtccctgacccttaggtggaagatgcagctatgcccaaggttctgaagaccctgtaaa

SEQ ID NO: 28094 - DNA, 201 bp, Homo sapiens
atgtttacatggggctgtggaccattttgtatcattggaggagaagccagggcacttggcaggggtgttcatgatgataatcaggtggctgggtggagtcrccatttgtggcatcctcaaagacttgccaacatagacatttttggggagacagaaacacagaaataattctgcagtgctttaaagaatctgttaaaaatc

SEQ ID NO: 28095 - DNA, 201 bp, Homo sapiens
cacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatcct

SEQ ID NO: 28096 - DNA, 201 bp, Homo sapiens
agacagtaagaaaggtgacgtcaatctgagatgagagagagagcaaaacagttcttttgaccaccttgaccccgaccttgaaataaggtggaactaataamtcccgctttgtgctggagcaagttttggctgagtttctgtcacttgcaaccaaatcagtcctatccagtatacctagtgactctctggtctccaaaggct

SEQ ID NO: 28097 - DNA, 201 bp, Homo sapiens
gtaagaaaggtgacgtcaatctgagatgagagagagagcaaaacagttcttttgaccaccttgaccccgaccttgaaataaggtggaactaataaatcccsctttgtgctggagcaagttttggctgagtttctgtcacttgcaaccaaatcagtcctatccagtatacctagtgactctctggtctccaaaggctatgcc

SEQ ID NO: 28098 - DNA, 201 bp, Homo sapiens
attatagtgtctggcatacaataaatactttgtaatgttactggtgtcttcttaccgttattgtctcactggtgaccgtttgaaatgttgaagctttattrttacagataatggtggatatagtctcttccttgtttattttttgacagaatctttttttaaaaaagtttttatttgtttggtgagaatttacttgttaca

SEQ ID NO: 28099 - DNA, 201 bp, Homo sapiens
aaacaaaaaggaggataccaatttaagcttgtcaaaaagattttcccccaaaagaaaaacacattaaaaacaacgacaaaaatcaacaaaaactaacactrttcccccatcaacaatcaatattactttctaaaagcaagggcgttttgacaccagatattgtgaggacatccacctgctctaagggacagccatttcact

SEQ ID NO: 28100 - DNA, 201 bp, Homo sapiens
ttcaaaagctacagagataccgtaacatttaaaaaaataaattttcattgtggaaatcaactgccacaaaaacacaaccttttacgagacaacgtgatgtrcatgagaagccctgatgttgagaagctcataattcggtgtgagaaacacacaaggcatgatgccattcccatctgggatgaacagggaagacttcctggg

SEQ ID NO: 28101 - DNA, 201 bp, Homo sapiens
gggcattaatgcatttagcaaagacttcctgagtgtctgcttggtcgagtgacacaaactggaacagagcatagcctgtcttccaggaaccggcaccagcratgtcgtaggctgagggagaagccacagaactgtgagtgacatgtttctttggctgctcccgacacaaggaactgcaactaaattgaaggcttgaggaca

SEQ ID NO: 28102 - DNA, 201 bp, Homo sapiens
agggagaagccacagaactgtgagtgacatgtttctttggctgctcccgacacaaggaactgcaactaaattgaaggcttgaggacaggaagcaccttagyggttcgcctttcatttgagtgggcccagggtccagaaaagggtagatattcaggaagaattgatcaccttttggatgccaccacacatgcctaggcacaa

SEQ ID NO: 28103 - DNA, 201 bp, Homo sapiens
tccggtgacatcctggattagaccctgaatcagaaaaaggactgtagtgggaaactcgtgaaatcctaaatacagtctgtcatttacttaatagtaacatwccattttcataagcataccatgggctgggcatggtggcttatgcccgaaatcccagcattgcgggaggctgaggcaagctgatcacttgaggtcaggagt

SEQ ID NO: 28104 - DNA, 201 bp, Homo sapiens
tttgtatatttagtagagacggggtgtcaccatgttggccaggcaggtcttgaagtcctgaccttaagtgatccaccctcctcggcctcccaaagtgctcrgattacaggcatgaaccactgcgcctgactgtacttttttttttttaaagtatacccatacccattgtacacatttggtattttttctttaaaaaaaaaa

SEQ ID NO: 28105 - DNA, 201 bp, Homo sapiens
gaacaagggttacgtttgctgtatctggagaaagtccatagtttatgatgaattttctattaatgtaaactcccactgtttataagtcacccaaattgttkgtattaaattagatgtgtaccatcttatgtctcttctttcagaaaatgaatctctgtttttttttctctttctcctaaatgttaggaattttctgaagtt

SEQ ID NO: 28106 - DNA, 201 bp, Homo sapiens
aattgctcctagggaaatacacatacacacacatgtacacacatacacatacacacattttttcctaaacaacatcaatgtcataacagttttgaagcacrtatacacactgacacatagattttgtaaatgaggcacatctattcttgaaatgcaattgcttaaaaatggaagttctgaaaataaataaaaagaaacatc

SEQ ID NO: 28107 - DNA, 201 bp, Homo sapiens
acattttttcctaaacaacatcaatgtcataacagttttgaagcacatatacacactgacacatagattttgtaaatgaggcacatctattcttgaaatgyaattgcttaaaaatggaagttctgaaaataaataaaaagaaacatcaataaataaaagccccattttcatattcttatttgacctcttgcctctccatca

SEQ ID NO: 28108 - DNA, 201 bp, Homo sapiens
gaaaataaataaaaagaaacatcaataaataaaagccccattttcatattcttatttgacctcttgcctctccatcattcttaaatttgacctccatcatkcttaaatttgacctccatcattcttaaatttgacctccatcattcttaatcctcatgttcttaatggacatccctcccaccctatctgggccttctgaga

SEQ ID NO: 28109 - DNA, 201 bp, Homo sapiens
gacctccatcattcttaaatttgacctccatcattcttaaatttgacctccatcattcttaatcctcatgttcttaatggacatccctcccaccctatctkggccttctgagactgttcccccagccccagtcaggagggcttgtccacaagttgctgtctgaactgggcaagcctcctggcttccctgaaatggtgctga

SEQ ID NO: 28110 - DNA, 201 bp, Homo sapiens
gcttgtccacaagttgctgtctgaactgggcaagcctcctggcttccctgaaatggtgctgatgtcttcacttcctgccaccttggcaacctttgtagttsctctctttttgccaggggaacaaattaagagagagaagagtgatagtgtctacatgtggtctgctcactcagccagtattttccacagccagtctttccc

SEQ ID NO: 28111 - DNA, 201 bp, Homo sapiens
caatatgatggctagtctgtttcatagtgaataaaaagtgatcctggatgaatgaataaagtgaaattcagataatttttctcaaaactgaaattgtttamatcttcctttagttctcttttttctgcctgccccttctttcatataccctgtttttcacctcttttgtctcagtcccatctgatatttgaataacaatat

SEQ ID NO: 28112 - DNA, 201 bp, Homo sapiens; identical to SEQ ID NO: 23326

SEQ ID NO: 28113 - DNA, 201 bp, Homo sapiens; identical to SEQ ID NO: 23327

SEQ ID NO: 28114 - DNA, 201 bp, Homo sapiens; identical to SEQ ID NO: 23328

SEQ ID NO: 28115 - DNA, 201 bp, Homo sapiens; identical to SEQ ID NO: 4176

SEQ ID NO: 28116 - DNA, 201 bp, Homo sapiens
gcgtgtgtgaaacacaaggtcacctgccaaaagcaaaacaattaggccagcattgggctaggtgaggatccattgtcttttgggcaggtgattgtgatacwataggagccggtgtcctgttgatggcatcccacaactttctaacctctgttgtagagttttgttagccacgatttggaccaacctgcagttaggccaagg

SEQ ID NO: 28117 - DNA, 201 bp, Homo sapiens
cctaggcttggttacaaagggcaatgaagggtcttttctgtccttaagcactcacaggtagcttaacagtaatgccttggattccttccttcaagagcgayagcaggaagcccagcttctctggtagcagagcaggggtcctcaaagcagaccgtgaggtcagaggagcactggagtcaggagtttccatctccaccctgc

SEQ ID NO: 28118 - DNA, 201 bp, Homo sapiens
taactcagttctcggaattttcaatcagaaattatctgatgacgggactaattcttattacgatagttccaatggatccacccaggatccacctccacaastaggtgtacagaagctggagatcccatcatgccgccgggcaccggtttacgagaactctatgtcttatcttggtagtacgattaggaaaacaaacacaat

SEQ ID NO: 28119 - DNA, 201 bp, Homo sapiens
agtttctgtgcatacaacatcttcctttctcattcccagtaccctagaaacacagccgttcactgaagaggatttgagtgttgtctcctctgtggggtcamaacatcatgcttctttctgttctgccccatggcagtggtgacgatggcctagcttccatcccgtagcttcttgtgtttttctattccaccagtctatcaa

SEQ ID NO: 28120 - DNA, 201 bp, Homo sapiens
tggcctagcttccatcccgtagcttcttgtgtttttctattccaccagtctatcaaccctgtatttgttgtcaaatttacactgtccacaggcaaagatcyattctcctttagaatttaataggagggtttggaaatgatgccatggaaaccctgagcagcttggcaatgctgaccccaaatgagaaataactatcattgg

SEQ ID NO: 28121 - DNA, 201 bp, Homo sapiens
gaacattccagggccaggttcagtggatcatgcttgtaatcgcagcatgttgggaggctgaggagggtggaccacttgaggccaggagtttgagatcagtytgggcaacagggtgaaaccccgcctccactaaaaatacaaaaaaaagaaaaaaaaaaagaaaaaaatagctggccattgtgacatatgcctgtaaccgta

SEQ ID NO: 28122 - DNA, 201 bp, Homo sapiens
tttgagatcagtctgggcaacagggtgaaaccccgcctccactaaaaatacaaaaaaaagaaaaaaaaaaagaaaaaaatagctggccattgtgacatatrcctgtaaccgtagctactctggtggctgaggcttgagtatcgcctgggaggcagaggttgcagtgagccaagatggcactgctgcactctagcctgggtg

SEQ ID NO: 28123 - DNA, 201 bp, Homo sapiens
tctcattctcctttccaataaatccttttattcccagaaacaagcattcttgtttcaatcattgtaactttgttttacctgttctagaacttcatttaatrgaaatcatacctactgctttgtatgtgtcgtcttctgcttaatgattcacataatgtttttgtgattcatccatgttgatgggtgtattaggggttctct

SEQ ID NO: 28124 - DNA, 201 bp, Homo sapiens
ttttgataaatacctaggtgtgaaattattgactcttagtgtttaacttgtaagaatgctgccaaacagttgtctaaagtaattgtatcattttaaccccycgctagaagtgtgtaagagtttatgttgcttcacatcctcatcagcactttgtaatttcagtctttttaattatagcctttttgtgggtgagaaacgcta

SEQ ID NO: 28125 - DNA, 201 bp, Homo sapiens
tagtgtttaacttgtaagaatgctgccaaacagttgtctaaagtaattgtatcattttaacccctcgctagaagtgtgtaagagtttatgttgcttcacakcctcatcagcactttgtaatttcagtctttttaattatagcctttttgtgggtgagaaacgctatctcttgctagttttattttgcattttcctagtgac

SEQ ID NO: 28126 - DNA, 201 bp, Homo sapiens
cagcactttgtaatttcagtctttttaattatagcctttttgtgggtgagaaacgctatctcttgctagttttattttgcattttcctagtgactaatgcmtctttttatgaactcattggccgttcatatattttctttctgtgaactgcttgtttatgtattggccattttctaaaaattagatagtctttttaatatt

SEQ ID NO: 28127 - DNA, 201 bp, Homo sapiens
gtccaatttatctttttcatttgtttagtgctttcttgttctaagaacctttaccaatcaccaggtcacaaaaatattttcctatgttttcttctagacastccataacttcaatctttacattcagatctatgttccatctcaaattaatttttgtatatggtgtgaggtaatggtagaggtttatttttctctccataa

SEQ ID NO: 28128 - DNA, 201 bp, Homo sapiens
actatttgttcaaagactaatcctcgcgctattcaatttccttggcatctttgtcaaaaatcagttgactatatatgtgtgggtgtatttctagactgttrtactccattgatctaattttttttcttatacttactgctcgattgcctggaagctaggtaataataaggattcaaactttgttctttatttcaagattgt

SEQ ID NO: 28129 - DNA, 201 bp, Homo sapiens
tttccttggcatctttgtcaaaaatcagttgactatatatgtgtgggtgtatttctagactgttgtactccattgatctaattttttttcttatacttacygctcgattgcctggaagctaggtaataataaggattcaaactttgttctttatttcaagattgtttgggttagtttagatactttccttttacatatata

SEQ ID NO: 28130 - DNA, 201 bp, Homo sapiens
ttggtattgaatctgttgatcaatttgaggaggatcaaaatcctgaaagtgttgagcgttaccatccatgagcatgcatctctccatttatttaaggcttstttatttataaacatttcagtgatatttgatgattttgaatgtggaggtcttatacttttttgttaaattaactcttacacatttgatttttttatgcta

SEQ ID NO: 28131 - DNA, 201 bp, Homo sapiens
cttcttctccaatttttatggcttttgtttctttttcttgttttaatgcactggctatagcctgtaggacagtgttgaacagaggttttgagacagacatmattgctttattcaggacttctctattatatgtgatcctagttgtatgttttctgtacctatacttcattagattaaggagtttgaatttatttctagttt

SEQ ID NO: 28132 - DNA, 201 bp, Homo sapiens
cttgttttaatgcactggctatagcctgtaggacagtgttgaacagaggttttgagacagacatcattgctttattcaggacttctctattatatgtgatsctagttgtatgttttctgtacctatacttcattagattaaggagtttgaatttatttctagtttgctgagagttcttttataaatgtgttcatatatata

SEQ ID NO: 28133 - DNA, 201 bp, Homo sapiens
tgagttctccataaatgttagttattattttaatattacagcatctgtggaaacagtgggtttatatttcagcgtcctgagaaacactcatcctgaacaaygggaacattggccacatccgccattgtcaattttaaataaaagatatgatgactagttggtgagttgatcttgtaagacttttacagatacccagaacgg

SEQ ID NO: 28134 - DNA, 201 bp, Homo sapiens
agttattattttaatattacagcatctgtggaaacagtgggtttatatttcagcgtcctgagaaacactcatcctgaacaacgggaacattggccacatcygccattgtcaattttaaataaaagatatgatgactagttggtgagttgatcttgtaagacttttacagatacccagaacggctctacttcttcatattcc

SEQ ID NO: 28135 - DNA, 201 bp, Homo sapiens
cctcctgttttgtgtcagctcagacactgaaggggaaagtttccagcctggtttctccatacactgaacatgttgaaatctatgccttaagcccaaatgarctgtcactcaagtatgcacgctcatattattaaaaactgtgcatgtaatttgctgggcacccaaataatttgttttttatttttccttaaaaatgagact

SEQ ID NO: 28136 - DNA, 201 bp, Homo sapiens
caaataatttgttttttatttttccttaaaaatgagactttctgttaggaaagtgattcatgaaacagtgaagatcctgcctcacaactttcaagaaaccsacagaggtccctattcacataagaattttctaagcagaggttccaatttggatatttcgtggccttcaggttatttgtaaccagtacacaaaccacaaag

SEQ ID NO: 28137 - DNA, 201 bp, Homo sapiens
tccggttctcccagtcattacctttctccttcaagctgggattcagagtccattttcatagggcaaaatgcagagttcgggttccttcctatccatgagartaggtgctgaaggagataaaggaatgaagacatagactttgaaagcaatagtctggcaatcatccaaaggtttgtgggaggacaaaagatcacaaagtat

SEQ ID NO: 28138 - DNA, 201 bp, Homo sapiens
acattatagaatattttcacggaaatatttcggatggaattttggctttaattctttctctttttttcctgttcttttccctctccccacaaccacttctstttcattttctgttttgctccttcttttcataagtagctggtagtcagtgttctctttttcttcctgtgagacaggatctccctctgttgcccaggctcg

SEQ ID NO: 28139 - DNA, 201 bp, Homo sapiens; identical to SEQ ID NO: 4861

SEQ ID NO: 28140 - DNA, 201 bp, Homo sapiens; identical to SEQ ID NO: 4863

SEQ ID NO: 28141 - DNA, 201 bp, Homo sapiens; identical to SEQ ID NO: 4856

SEQ ID NO: 28142 - DNA, 201 bp, Homo sapiens; identical to SEQ ID NO: 27085

SEQ ID NO: 28143 - DNA, 201 bp, Homo sapiens; identical to SEQ ID NO: 4865

SEQ ID NO: 28144 - DNA, 201 bp, Homo sapiens
tactcaaataagtctcccccaaaactcagggatagagatttttaaggagaatttagtgagaagggggtcagggaatggggagtattgattggtcaggtttragatggaatcagggagttgaagctggcctcttgcactgagtcagttcctgggtgggagccacaagaccatatgagtcaatttattgacctgggtggtgcc

SEQ ID NO: 28145 - DNA, 201 bp, Homo sapiens
catcaattgcagggtctgcaaagtatctaaagtactgatgttcggttttaccatagtgacattatcccctggagcaatttggggaggttcagaatcttgcrgcctccggcagcatgactcctaaaccctaatttctaatcttgtggctaatttgttagtcctgcaaaggcagtctagtccccaggcaggaaggttgtttat

SEQ ID NO: 28146 - DNA, 201 bp, Homo sapiens
ccatcccactaatatatttcttaccaggagtacatagtttgttctttaagcaaaaccatatgcatcgtattttaaatggaacagggaggttgttccatgcrtcaacttagtccaaatgtagagggtcaggaaaacaatgatatgagaaaagggccggttactgtctgggaatccataaatactgcttggcaaatggcacat

SEQ ID NO: 28147 - DNA, 201 bp, Homo sapiens
aagcaaaaccatatgcatcgtattttaaatggaacagggaggttgttccatgcgtcaacttagtccaaatgtagagggtcaggaaaacaatgatatgagaraagggccggttactgtctgggaatccataaatactgcttggcaaatggcacattgcatgcttattccttaggcatccgtttagcaaaataagatgtcaag

SEQ ID NO: 28148 - DNA, 201 bp, Homo sapiens
taactaccttgcttgcctatgggacatgttcccatttcagtgcatacttgacctttaccataaatcacatatttgtaaactgtaccctcctgctgttttaytgggcatggagaagcagtcttttctttttcttgatggcctgggttgaccagatcctgacttttgtggagacattaaagtgctagaaatgataatggtgaa

SEQ ID NO: 28149 - DNA, 201 bp, Homo sapiens
ttggtaattgaatgaaataagactcttaggaaaattctccccagtggcaatgttgtaagaaacaccaggccgggcacagtggctcacacctgtaatcccarcactttgggaagctgagacaggcagatcacttgaagtcaggagtttgagaccagcctggccaacatggttaaaccccatctctactaaaagtacaaaaat

SEQ ID NO: 28150 - DNA, 201 bp, Homo sapiens
acctgtaatcccaacactttgggaagctgagacaggcagatcacttgaagtcaggagtttgagaccagcctggccaacatggttaaaccccatctctactraaagtacaaaaattagccagacgtgatggtgcgtacctgtaatctcagctactcaggaggctgaggcaggagaatcacttgaacccgggaagcggaggtt

SEQ ID NO: 28151 - DNA, 201 bp, Homo sapiens
acctgtaatctcagctactcaggaggctgaggcaggagaatcacttgaacccgggaagcggaggttgcagggagctgagatcacgctgatgcattccagcstgggtgacagagcaggactccatctcaaaaagaaaaactcaacgaaacaccccagcttctatcattctcaagcttagtgtgtgcaagactcatggatgct

SEQ ID NO: 28152 - DNA, 201 bp, Homo sapiens
gatggcagctcaaggggtttttgcctgcgtcttcacccaaagccactaacacgggatctgtcaattgcattgctggtgatcaagaaatgccagctcctccrctcttccctgagtgccttgttggagacaaaaccagcaggattatatccccagcactgtaatttagtgtggcagtcaggggaaaacaccttgtagaatttc

SEQ ID NO: 28153 - DNA, 201 bp, Homo sapiens
attggttagatgccgtatctttaaaacaccatcagcttggaaaacactatccattagcaagagatcagagcaagagaaacctcgaagggtcgaacggtccrttctgagggctccacaaagaactcggcatcccagaaggatgattagccttccatctctcgagttgtctcagagcacaacaggtctgagtgtttttttctt

SEQ ID NO: 28154 - DNA, 201 bp, Homo sapiens
catagctcactgcagcctccaactcctaggctgaagccatcctcccaccgtagcctcctgaatagctgggactaaagtgtgcaccacaatgcccagctaasttttgtattttttgtagatacggggtcttgctatgttgtccaggctggtctcaaagtcctggcctcaagtgatcctcctgccttggcctcccaaagtgct

SEQ ID NO: 28155 - DNA, 201 bp, Homo sapiens
agtatcattctgatgtagggaggatatcacctcacaggagtctttcctggctatcctgtccaaagtcactactcacaatttctctatcccataactctatyttatttctctgtctagcacttatcactatctgatattttctgtctatccatccgtctattcattcattcattgctaatttattagtattgccttcccatg

SEQ ID NO: 28156 - DNA, 201 bp, Homo sapiens
tcacctgtcctttatcttggctggtccaattccataagaagtaaatgctgtgtgtctgcaattcaaaagacccctttcacgggaggctgggagatttttcyatctaaatagcttaattgttactctacagggcaatcataaatgtaaatcgacttaatatgacttgattgttagtaatgactgtgcctctaatgacgctgg

SEQ ID NO: 28157 - DNA, 201 bp, Homo sapiens
acagtgttatcagtcattgactcagaagatagtttcttaccgtttggggaaagtgcttgtctattcctctccaaagccattttaaaaaaaaaattgcaccrgttctcatcccatcatctgccttgatcaaacatttgcttattggaatcacttcgaaaaggaacttggtatcgttcacatgtgtttataactctcaaatct

SEQ ID NO: 28158 - DNA, 201 bp, Homo sapiens
tgatcaaacatttgcttattggaatcacttcgaaaaggaacttggtatcgttcacatgtgtttataactctcaaatcttcttcttccaatttttaatcttsatcaccacagctttataacaggaagaacgctcaaagaagaaaaatagaagaagcctgaattttaatttgctatttcttcacacacaaaacaccccaagct

SEQ ID NO: 28159 - DNA, 201 bp, Homo sapiens
tttgaactctaattagggaaagggaatttggaaccattgtcttctctgagtgtgcagacacgatgttatcattgtgtttacagaggtggtcagattcccakcacagtgtactcccgcacagataaccgtcccatcttgataaaacaatgctctcagccgaatcctaaacacgctgcacaaggaagaccttatgctgacagt

SEQ ID NO: 28160 - DNA, 201 bp, Homo sapiens
ctgataaattctgggaaagtttatccaattgttacaacccagggtcaggaaaactgttttcaattttctgctgtatgaagttgccagtgttaaaccctttygatagcaagtagaagaaatgttcattcaaacaggcttaattaactgaaagatataggtgtggtaaggggatcaggtaaagcttgacccaggggctaaact

SEQ ID NO: 28161 - DNA, 201 bp, Homo sapiens
aaccacatctttccagattcaatatagtaggagaagaccagacttgctcttttcctggaatttagtctgacgtggctgggacaacatgcccactctcaacyaatttttgtagccatggagatttggaagtctggcaagtcttgggtcacatgatctaccttacagctgttactgcagacctcccaaagctcacgaactgag

SEQ ID NO: 28162 - DNA, 201 bp, Homo sapiens
atccgtcgttccaaatatgagcactttctcttgtcttttctgagctacctattccaagaacacagaggagttgttattgtggttacttgtggtaagaagastacctttctgattggacccagggcagaaaaaagaactttcaggtggaaatacagtcgtggtgtcaggtagtgtgtaacttcgttaagttcagtcatagca

SEQ ID NO: 28163 - DNA, 201 bp, Homo sapiens
gttccaaatatgagcactttctcttgtcttttctgagctacctattccaagaacacagaggagttgttattgtggttacttgtggtaagaagagtaccttyctgattggacccagggcagaaaaaagaactttcaggtggaaatacagtcgtggtgtcaggtagtgtgtaacttcgttaagttcagtcatagcagccgctg

SEQ ID NO: 28164 - DNA, 201 bp, Homo sapiens
cccgggatcaagcgattctcctgcctcatgctcccgaatagctgggattacaggcacacaccaccacacctggctaatttttgtatttttaggagagaggkgttttaccatattggcccagctggtctcgaactcgtgacctcatgatccactcgccttggcctcccagagtgctgggattacaggcatgagccactgcac

SEQ ID NO: 28165 - DNA, 201 bp, Homo sapiens
attgtatcagtcagcgtagactaggtttgccgcagtaacaaacgaccccaccatgccatagcttgcaaaaacaaagactgagttcttgtctacactgtagkgccgtcaagagctggctctgcttgctcttggtcttctccatgccaggatccagagtaaaagcacagcttctctctaggactccaggggaaagagaaaaga

SEQ ID NO: 28166 - DNA, 201 bp, Homo sapiens
gctcttaatatcctataattgaaaaagagattgccattttcaaagacctttcacagtcattctcttaatcaagtctcataataaagatgtcattgggactkagcagcttactcacattctcatttcactgatgaggaaactggagctcagggaggttacatggattctggatgacctacaggtcatggaggtaagagagga

SEQ ID NO: 28167 - DNA, 201 bp, Homo sapiens
ttgtccttactctgacacccactgcaagtttgaggtggtcctcaaacccatcctcatggctgatatttgctagaaggacttgtggcacttagcagaagctrttgtatttacagttacagtttattacagggaaaggatacaggttaaaattagatcggggaagagacaaatggggcaaagtccaagacaagtaccagatgt

SEQ ID NO: 28168 - DNA, 201 bp, Homo sapiens
gactctttttttcaggaatatattctgcatatatttcagtgatttttttttttttttgagacagtctctcattctgtcgctcaggctggagtgcagtggcrtgaccttggctcactgcaatttctacctcccgggttcaagcaattctcgtgcctcagcctcctgagtcactgggattacaggcatgcacaacaacaccca

SEQ ID NO: 28169 - DNA, 201 bp, Homo sapiens
tttttttttttttttgagacagtctctcattctgtcgctcaggctggagtgcagtggcatgaccttggctcactgcaatttctacctcccgggttcaagcrattctcgtgcctcagcctcctgagtcactgggattacaggcatgcacaacaacacccagctaatttttgtatttttagtagagacagggtttcaccatgt

SEQ ID NO: 28170 - DNA, 201 bp, Homo sapiens
attggtaaaaacatatatcagagtccttttgactgtttagaaagtgttaatttactccacgattatccattcaacatttattagttggcttctgtgtgggwgagtaaccattaataccttgaataagtttataatctggtcattctgtagagcttcctatatgatgtcttctgtttaagtatttctgtaataccttataga

SEQ ID NO: 28171 - DNA, 201 bp, Homo sapiens
gtccttttgactgtttagaaagtgttaatttactccacgattatccattcaacatttattagttggcttctgtgtgggagagtaaccattaataccttgamtaagtttataatctggtcattctgtagagcttcctatatgatgtcttctgtttaagtatttctgtaataccttatagacatctcttttagactactagtg

SEQ ID NO: 28172 - DNA, 201 bp, Homo sapiens
gaaagcagtgctcagaggtaaagagcctcgctgaagccctagttctagcctaccaggatttggtcatttcttggtttttcatttgatcccacccttgcctmccttcagaatgaaggtagaatgtgggactgtttcagaccatgaatgcgattgggcagaaagactgtgaaccaagagggcagggagaagggaagggatgtg

SEQ ID NO: 28173 - DNA, 201 bp, Homo sapiens
tgagcccaggagtttgagaccagcctgggtaacatggcaaaaccttacctctcaaaaatttacaagcttagccaggcatggtggtgcccacttgtggtttyagctacctgggaggctaaagtgggaggatatcctgagcccaggaggtggagattgcagtgagccatgctcgtgccattgcatttcagcgtgggtgacagt

SEQ ID NO: 28174 - DNA, 201 bp, Homo sapiens
ctcgtgccattgcatttcagcgtgggtgacagtgagaccctatctcaaaaaaaaaaaaaaaagttcctaagaaaataaagcctggcccatgcaatttgaaygtaactgtctataatttctcttggttactgaaattctgagtttgtgtctatggtttctccatccttgtctttgaggaggagcaggatggcgaagtcgcag

SEQ ID NO: 28175 - DNA, 201 bp, Homo sapiens
tggaattataggcatgagccaccatgccctgcccaggcaccattcttgactgcgagaaagtcactgtgatggtttctccagcctgagttttctcctgtatraaatggaccttgttttgaggagagaatgaggtatgtggtactcgtgagcaggattttcaatgcctggctggttgttacttatccatttagtccgagcttc

SEQ ID NO: 28176 - DNA, 201 bp, Homo sapiens
agaatgaggtatgtggtactcgtgagcaggattttcaatgcctggctggttgttacttatccatttagtccgagcttcagggaaagaacatgacaccggcstccagcagagcctgctcttggtccactgtttatcctggtgaccttaggcaagtcatttaatttccttgagttttggtgtaagtattgatggagcagacca

SEQ ID NO: 28177 - DNA, 201 bp, Homo sapiens
agcaggattttcaatgcctggctggttgttacttatccatttagtccgagcttcagggaaagaacatgacaccggcctccagcagagcctgctcttggtcyactgtttatcctggtgaccttaggcaagtcatttaatttccttgagttttggtgtaagtattgatggagcagaccatcaataactgttcttatgtctatt

SEQ ID NO: 28178 - DNA, 201 bp, Homo sapiens
tgtgtgtgtgtatgtgtgtgtgcgtgttatatgaagtcttgctagaatgcataaacaaacaaaaaaaatatcatactctcagatcctggatactgtggtcrcctggacttcaaaagccttttgtccgtatgtatttacataatgtattctccatgtttggttttcattaaacccatgagtttaataataaagtgtttggaa

SEQ ID NO: 28179 - DNA, 201 bp, Homo sapiens
gtgttatatgaagtcttgctagaatgcataaacaaacaaaaaaaatatcatactctcagatcctggatactgtggtcgcctggacttcaaaagccttttgyccgtatgtatttacataatgtattctccatgtttggttttcattaaacccatgagtttaataataaagtgtttggaactatgcttttccctaccactttt

SEQ ID NO: 28180 - DNA, 201 bp, Homo sapiens
aaatgtatttaacgctctctcaagaaatccatttaagaataagaacacggtttgggggtgattttcagaccgtaaattgaagtgtaaatattcgaattatyttcataaactcttcagttctgttgggcttttatgttatcatacagtgatttttttttttgtatttaagttttctagcagttctcttttttaagagcctca

SEQ ID NO: 28181 - DNA, 201 bp, Homo sapiens
gagcagaagaactcactgaaaagtcctggcaaggttccacggcacctgtgatgcttccatcacacatatttgctgagtacccgctgttcataggtcagtcrctatgcaaggcactgaggtgacaaagacaagcagaatgacagttaaatgtaacatgggctttgtggtcaattagttctgggttcgttcccaggtcctatc

SEQ ID NO: 28182 - DNA, 201 bp, Homo sapiens
ggttccacggcacctgtgatgcttccatcacacatatttgctgagtacccgctgttcataggtcagtcgctatgcaaggcactgaggtgacaaagacaagsagaatgacagttaaatgtaacatgggctttgtggtcaattagttctgggttcgttcccaggtcctatcactaactagtacccttatgaacctggacatgt

SEQ ID NO: 28183 - DNA, 201 bp, Homo sapiens
ccacactcaggaatagtggaaaactgacaagaccctggagatgctgtgtggggagggataatgggaacgcaggtcagcatgctctaggaatggtaagagaractcccaatctgaacggtagtcaaagaaggtcttcttctctttggagactgaaaggctgagagggtacctgccctgctaaggaaatgaacaggacggaag

SEQ ID NO: 28184 - DNA, 201 bp, Homo sapiens
ggaaatgaacaggacggaagaatgatggagggagaatgggaagtcctcagcacataaaagtttgagctggaaatgaaatatacaactctgcatagtcagcrgattttgctgggctgggccagttcagctcagcaaggattgctgggcatgtgcttgaaggagaaaggtgaggatacaaaggcaatgagtacatgatccttg

SEQ ID NO: 28185 - DNA, 201 bp, Homo sapiens
ctccacattggccttctgccgtgattgtgagactttcccagccatgtggaactgtgagtccgttaaacctctttcctttataaattactcagtctcaggtwtgtctttattagcagcatgagaacaaactaatacaccacttgaattgctggtacgtctgaggggcttgactcccagtccttcgaacatggaggggtagct

SEQ ID NO: 28186 - DNA, 201 bp, Homo sapiens
atgtctttattagcagcatgagaacaaactaatacaccacttgaattgctggtacgtctgaggggcttgactcccagtccttcgaacatggaggggtagcyctttttctaagctcctcataaagtattgtatccaattcttcagaagggatgaaggtatctggtcctgtccgcaaacagagaagtgcttcttgtactgacc

SEQ ID NO: 28187 - DNA, 201 bp, Homo sapiens
ggggtagctctttttctaagctcctcataaagtattgtatccaattcttcagaagggatgaaggtatctggtcctgtccgcaaacagagaagtgcttcttrtactgaccaggcagtgacctaacgcagtccttgagacaattccaggtgcccctcaggccgtttttccaccctggtgtttttctttgtatagacagcctat

SEQ ID NO: 28188 - DNA, 201 bp, Homo sapiens
tccttgagacaattccaggtgcccctcaggccgtttttccaccctggtgtttttctttgtatagacagcctatgcctggataagaacatgctgcgtcagasagttctttttcactttgcccctcaaaatgtgcacaccgacagccacagatagatcccagatgtctttttcctgctcttgcaaaccttgaagtgggccctg

SEQ ID NO: 28189 - DNA, 201 bp, Homo sapiens
cctggataagaacatgctgcgtcagagagttctttttcactttgcccctcaaaatgtgcacaccgacagccacagatagatcccagatgtctttttcctgmtcttgcaaaccttgaagtgggccctgccggcaggcacacctgccaaggaaaatgctgtcctcgaaatgttcctggcaccgttttcaagaggtgccgacca

SEQ ID NO: 28190 - DNA, 201 bp, Homo sapiens
caagcgctggaattgctgacctccctgaaagagaagcctgcagctgcggcctctggggtgaattccccccatgggaggacctggtggagttaaaacagackatatccacatcacagagagctggcccattgctcagggcctgggaagtggtagggagggaccttcccagaagagagatgactcaggctggtcccaagcccc

SEQ ID NO: 28191 - DNA, 201 bp, Homo sapiens
ggcaggccaaggcgggtggatcacctaaggtcaggagttcgagaccagcctgaccaacttggcaaaacccagtgtctactaaaaatacaaaaattagctgrgcatggtgtcacatgcatgtagtcccagctactcaggaggctgaggcaggagaactgctcgaacccaggaggctgaggttatgttgagccaagattgtgc

SEQ ID NO: 28192 - DNA, 201 bp, Homo sapiens
ggcgggtggatcacctaaggtcaggagttcgagaccagcctgaccaacttggcaaaacccagtgtctactaaaaatacaaaaattagctgggcatggtgtyacatgcatgtagtcccagctactcaggaggctgaggcaggagaactgctcgaacccaggaggctgaggttatgttgagccaagattgtgccactgtactc

SEQ ID NO: 28193 - DNA, 201 bp, Homo sapiens
atgttgacataacagttctgaagaccaaggtggtggaataggttaggttaggatacgtcggaggagccagtgtgaactgctcctttaagacatgaattagyccattttcatgctgctgataaagacatacccgagactgggcaatttacaaaagaaagaagtttattggacttacagttccatgtggctggggaggcctca

SEQ ID NO: 28194 - DNA, 201 bp, Homo sapiens
agaggagagcttgtgtagggaaactcctgttttttaaaactatctgatctcgtgagacttattcactatcacgagaacagcatgggaaaatcctgcacccrtaattcaattacctcccaccagcttcctcccacgacatttgggaattgtgggagttacaagttgcaattcaacatgagatttgggtggggacacagctaa

SEQ ID NO: 28195 - DNA, 201 bp, Homo sapiens
ccggggccgggcacggtggctcatgctggtaatcccagcactttcggaggcctaggtgggcagatcacaaggtcaggagatggagaccatcctggctaacrtggtgaaaccccgtctctactaaaaatagaaaaagaaattagcctgacatggtggcacatccctgtaatcccagctactcgggaggctgaggcaggagaa

SEQ ID NO: 28196 - DNA, 201 bp, Homo sapiens
taatcccagcactttcggaggcctaggtgggcagatcacaaggtcaggagatggagaccatcctggctaacgtggtgaaaccccgtctctactaaaaatasaaaaagaaattagcctgacatggtggcacatccctgtaatcccagctactcgggaggctgaggcaggagaatggcgtgaacccaggaggcggatcttgca

SEQ ID NO: 28197 - DNA, 201 bp, Homo sapiens
gggattttagttgctggatgctgaagttctgccaacacagtgggtttggagagtaggagtgaaagagtggagactggccataagttgggagggtaagtaaytggttgtgattgaaaggaaagaaggaggtaatgatgagttttggtctgggaaccggagaatggtggtccatggacagaaatagagaaggcaagatgagaa

SEQ ID NO: 28198 - DNA, 201 bp, Homo sapiens
gaataaataggtacataagtgcttgctagcaagcagctgaggcaacctattaaaactcatgccagtggtaaagttaagctgctttctggtaagaatttcasaattccaggacgtctcaaatttctggctggtacaccctgggtaaggtccacaggctggatgggttttggaacatgtcttgattgtactttttcctcttgg

SEQ ID NO: 28199 - DNA, 201 bp, Homo sapiens
tgaggcaacctattaaaactcatgccagtggtaaagttaagctgctttctggtaagaatttcagaattccaggacgtctcaaatttctggctggtacaccytgggtaaggtccacaggctggatgggttttggaacatgtcttgattgtactttttcctcttggtttggaaagcaacgtaccctaggtaaggagagatttc

SEQ ID NO: 28200 - DNA, 201 bp, Homo sapiens
caacctattaaaactcatgccagtggtaaagttaagctgctttctggtaagaatttcagaattccaggacgtctcaaatttctggctggtacaccctgggyaaggtccacaggctggatgggttttggaacatgtcttgattgtactttttcctcttggtttggaaagcaacgtaccctaggtaaggagagatttctgaca

SEQ ID NO: 28201 - DNA, 201 bp, Homo sapiens
gcaacagtgggtttttgttaaatacggcaaatattaagagtcgtctctgggcattttagtttattcattcatttgttcatttattccacagggatttattrtgcatttactgtgtactaactaatggggagatagcaatgaaggcagactaagtgtctttgttctagtgcagccatatagtcagtgaatgaatgagtgagc

SEQ ID NO: 28202 - DNA, 201 bp, Homo sapiens
taaagtgatagagaggggctggcgaggagagcagtctaatttcaggaaagtcagaaaagtctttaaggaaactgaaggctgagctgccagggccagccacrtgggtactggagagtgggaggcccagtcacggggaatgctggcttagcacaactgaaaaatacaaaggtagaatatgaagtgtaatgacatggtttagat

SEQ ID NO: 28203 - DNA, 201 bp, Homo sapiens
gcagtctaatttcaggaaagtcagaaaagtctttaaggaaactgaaggctgagctgccagggccagccacatgggtactggagagtgggaggcccagtcasggggaatgctggcttagcacaactgaaaaatacaaaggtagaatatgaagtgtaatgacatggtttagattgaaatctgatgtggatggaaaggttttgt

SEQ ID NO: 28204 - DNA, 201 bp, Homo sapiens
taatgacatggtttagattgaaatctgatgtggatggaaaggttttgtggcctttcagcccaaggtttgaaaaagaaatggaatttctaaatggagtgggyagccacaggagggctttagacaggaccgtggccccgctggattttctgcccattgacttgggctcgaagtcacgtccatgttgctattacagatgcctcc

SEQ ID NO: 28205 - DNA, 201 bp, Homo sapiens
atgtggatggaaaggttttgtggcctttcagcccaaggtttgaaaaagaaatggaatttctaaatggagtgggcagccacaggagggctttagacaggacmgtggccccgctggattttctgcccattgacttgggctcgaagtcacgtccatgttgctattacagatgcctcccagaacagtttatataatcgtcaacgt

SEQ ID NO: 28206 - DNA, 201 bp, Homo sapiens
acaggaccgtggccccgctggattttctgcccattgacttgggctcgaagtcacgtccatgttgctattacagatgcctcccagaacagtttatataatcrtcaacgtatattcatggagcatcttctgtctgctagacacagaattgggtgttgggctttaaagatggatgaaaggcagtacctggtctagagaggctgc

SEQ ID NO: 28207 - DNA, 201 bp, Homo sapiens
gctagacacagaattgggtgttgggctttaaagatggatgaaaggcagtacctggtctagagaggctgctacctggatggtgtgtttgccatcctcagtartgtgtgtcccttacagatgatgcccagtgactctacaattgctgggatactttttagaattttctttttgtgcattacttttgattcttggttctttctt

SEQ ID NO: 28208 - DNA, 201 bp, Homo sapiens
ttaaagatggatgaaaggcagtacctggtctagagaggctgctacctggatggtgtgtttgccatcctcagtagtgtgtgtcccttacagatgatgcccartgactctacaattgctgggatactttttagaattttctttttgtgcattacttttgattcttggttctttctttggcattagctcaccagtggcaaatat

SEQ ID NO: 28209 - DNA, 201 bp, Homo sapiens
gacataggtctggcgatctttttggcatagacgtgtggacgttgtttttgacatttgtacatgcttttgctcaagttgaaggcccaagtttacccaattcractgcccccacccagatagaatattcatggttagaccataaactacataactggaaattttaaatctatttttatatgcatacaaaaactgcaggcctga

SEQ ID NO: 28210 - DNA, 201 bp, Homo sapiens
ataaactacataactggaaattttaaatctatttttatatgcatacaaaaactgcaggcctgaagcttctaaaaataaacgttactttcatcccattatasaaaaatgcatttgaggtggtcatcattttatttgggccagggtcttccgagacttgggacaataatatattttttctactttaggcaaatgtatgcagat

SEQ ID NO: 28211 - DNA, 201 bp, Homo sapiens
gcagattcttaaagcatgaatgctgtattacacacattataaattcgagtaacagaaatgtttgtgtgtagaaatagaatacggagtatatattttgtatwaaataacctctgtggtatttgtttaccctgattttttgatttatgagtcgtcattgctcgctatagaagaagaaaaataaatatgcaaaacagtggtaga

SEQ ID NO: 28212 - DNA, 201 bp, Homo sapiens
tatatgtctttctttcttttcttaggttaacttttttttttttttttccttttgaatgaccacaaagcatatctacccagcggggttactttttttttccytttcagtattcatgacgtcaagtccctgtttgttatcttattgtcctcttatcctggtccttagagtctttcaagagaagaggttgatcccggtgtaatg

SEQ ID NO: 28213 - DNA, 201 bp, Homo sapiens
gctgatctgcatagcacttcgcaatgaagctgtgctctagaaacataccacgatctactggactttcttaaataaggtggttgttcaggaaattcctccarttaattttactttaattccccctacaagaatgccgagacacctctgcctattttctctttctgtgtttgttgtttcttttgtttttgttttcgagactga

SEQ ID NO: 28214 - DNA, 201 bp, Homo sapiens
aggatagtttcccttcctggaagattgagatgaaataaagctttaggagttggtatcgcacgcaggcattaaatggattgtgaagagggactttgttcccsctcagtcttgtctctgcctccgtaaaggagtaagttaaaaaagaaagtttctttttttaaaaaaaagccttactgctcaataaatccctgtggaaaaaaa

SEQ ID NO: 28215 - DNA, 201 bp, Homo sapiens
atttgttatttttctcttcccccccttagctgtatccctgcatttattacagcgcaggtgcatcttgcttttgagtgctaactgagatgaaaggagtgagraaacgctctcttcttcttgcaggggagggctggcaaattcagtgaatgcagagtcggctgggagcctttcggctggaaagctcttcctctgatgagctgt

SEQ ID NO: 28216 - DNA, 201 bp, Homo sapiens
gtcagataacccccgatcgtaataagccggaggataatcgcttgcattgttcaataaagcaattgctttgtcccctcacttagccccttcagaaaagccaraaagaatgtgccacctagatgctatttataaccattttcacctcttgcctccaggggctaaattggaaacctaattttagatgcataaaagccaaaatat

SEQ ID NO: 28217 - DNA, 201 bp, Homo sapiens
taattatgtcattgaaaaaaacaccagtaattaaatcattatttcttagatgtgaggtccaaggacattctagaggaagtcaaaggcagagggaggaaggrtgggacgatggaggcctgaagggctggtggagaggaaagaaggcagcctgtgccgtcagagagagttcaactccatccgtgcagctgctagcatcttgcc

SEQ ID NO: 28218 - DNA, 201 bp, Homo sapiens
taacacctgcctccgtggtttgtcaggacatttagaaatgcagacttgctcaagacctggatctcaggtggtaggttggtccacagacagtggcaccactmgctattatttatttgttgtcactgtttgggacccctgttgctgtctcaccaaagaacttcttgtctcccttttagaagtttccagagcgtcttcctgatg

SEQ ID NO: 28219 - DNA, 201 bp, Homo sapiens
ataggaaggttatcctgggtgattagcatggatcagagttctcacaggagcccttcaaagcagaaggggaaggtggacaagagaatcggagagatgtggcrgagggtaggcagagagattgcaagcagggaaggatttcacgtactgccactggctttgaagatggagggggcacatggctagaaatatgggcggccctca

SEQ ID NO: 28220 - DNA, 201 bp, Homo sapiens
aaggctcgtgttaactccatctggacaaagccttgaggtatacgtgtggcttcttttgagcatcgtgccatagctgtccctgatctaccttgcggggcaawcacaacaagtaaaaggttttcctcttgaaggattgaacgcctcaatgcgtgcatcctacattgtctagtgggagaaatctccgttgtagattctgacatg

SEQ ID NO: 28221 - DNA, 201 bp, Homo sapiens
atatactgcacatgtttttgtttttgtattttggttcaaaaagagagtatgatctcacttttcccttcttgataggttgtagattccatgtctaatccatscttttccaatattccctcctaatctttcagttgaattatggtctttagctcaaatgcatgacatgatgtgtgtgcctttggagtggggcggtattagtca

SEQ ID NO: 28222 - DNA, 201 bp, Homo sapiens
aaagagagtatgatctcacttttcccttcttgataggttgtagattccatgtctaatccatgcttttccaatattccctcctaatctttcagttgaattayggtctttagctcaaatgcatgacatgatgtgtgtgcctttggagtggggcggtattagtcagtcgatggttatttccttgaggagaaaggaaaggagaag

SEQ ID NO: 28223 - DNA, 201 bp, Homo sapiens
ctttcagttgaattatggtctttagctcaaatgcatgacatgatgtgtgtgcctttggagtggggcggtattagtcagtcgatggttatttccttgaggaraaaggaaaggagaagttgagtacttttcagtgtttgttactacaaaagcatggtggcatgccattgttctgagaggaagggggttttttgccttgtcagc

SEQ ID NO: 28224 - DNA, 201 bp, Homo sapiens
gtaggacaatgagaagaggccagatgaggacagaatttttattttccattgccagtaacaaacacagccctaacttgcttagaccaaagatggggattgaytggcaactgggaagcctaagggtggatctggcgtggctggatctaagtgattaaatggcgcggtcataattctatttctctgcatctctcagctgtactt

SEQ ID NO: 28225 - DNA, 201 bp, Homo sapiens
aatttttattttccattgccagtaacaaacacagccctaacttgcttagaccaaagatggggattgattggcaactgggaagcctaagggtggatctggcrtggctggatctaagtgattaaatggcgcggtcataattctatttctctgcatctctcagctgtacttccatctctgtaaacttcatttgcagacatggcc

SEQ ID NO: 28226 - DNA, 201 bp, Homo sapiens
gctccatcaatacccatcccaggagacagtggcagtcttgatgtcaatcttgttttaggatcattgccagtggaattcaggactgcggttctacccggtaycggggaaccaggtgagggggttaagaggcctgggcccatggaaggggtgagagagagccacatacttacagttgtgaagggggccagccaggatggtggc

SEQ ID NO: 28227 - DNA, 201 bp, Homo sapiens
atccctcgacccagtgacctagcccccgtgtaccttccctgtctcatttctcactgttatcattgtaaccctctaccctctcttttggcttcctgcagttkccctcctgcagcagggcttttgcacatgctggtttctcccttactttgcctctactcagtctttatatttcaactcagtggtcactgtctctaggaagcc

SEQ ID NO: 28228 - DNA, 201 bp, Homo sapiens
ctgacctcctaagttagagcccctgggaagttcagccgtggttctgaccaggcaggataactatctaagtgttcccctttggacctagactgagccaaagwttctccttggtctatataggataatagatttctaaaacaaaccaatagctcaggcacaattatagtggggggtggggggcatgtttaacctactttagag

SEQ ID NO: 28229 - DNA, 201 bp, Homo sapiens
tattgaattttggcccacaggaaaaggaaactttgctgttagggtcagctggaggagagactgcaggggtcagagatcagggccatatgctagagctgcartgtgggtgctcaaatgatgttcagtgcatcttcacagatggacctccacatgtccctcatgccctaaaatagatattctccacagctgcacatacaacaa

SEQ ID NO: 28230 - DNA, 201 bp, Homo sapiens
tatgctagagctgcaatgtgggtgctcaaatgatgttcagtgcatcttcacagatggacctccacatgtccctcatgccctaaaatagatattctccacasctgcacatacaacaacgtcagtgaaatccgttgagaggagcattgaggagatgagtcaggtgtgccgcagcactcaggtcagacttgaggcaagtgagag

SEQ ID NO: 28231 - DNA, 201 bp, Homo sapiens
atgcctggcctctggccttcttttcactttagaaaaaaacaaaaaacaaaaaacaaaaaaaaacacaaaaaaaacttttttttttagaactgttttagttkgggagccaaaattgagcagaaagtacagagagttcccgtatacctccggcagagccctggctcactatctacatccccactagatccatgtatttgttta

SEQ ID NO: 28232 - DNA, 201 bp, Homo sapiens
atcatatattgtatcatatcatatcatgtcatatcatatcatatcataccgaataatttcattgccctaaaatacctctgttttcactttttaatctcttwgtgcacacatcaaaaattccttttgtgtttttgagtttcaaaagtgtgccacaaacaagaaatttgggatctgctgagcccagcctcagacctgtagggg

SEQ ID NO: 28233 - DNA, 201 bp, Homo sapiens
gaaacaaagagggcaacaggaggtcacgaaggcatgctgtgcccacttttggaaattgtgaaggagagtgtctcaaacatgtaggcttgagccactcaaarttctgggaaataggatgttttgtaaagaaagtttgctactgtcacttctgagtagttgcagtccctcccagtacgtgggtatcttcggtgagaacaaatt

SEQ ID NO: 28234 - DNA, 201 bp, Homo sapiens
ctcatgtgactttctatatcatcctttgtgtctaagtgatttgcactgggaagatagtaaacgctcccactttatatgcagaaggttgaaaacaccatgartgttgcaatctgaggtatctgcccttaaagaagcaatatttactgaaatgcagggcacacgacttttccagcaaaccacaccgccgtccttttgtgtgac

SEQ ID NO: 28235 - DNA, 201 bp, Homo sapiens
attcataactcagtcacgttactgaggtatgtctcttcggatagattctatctctaaaaactacagattctatctctaaaaacttaagtcaagggattttsaagcagttgtttgatttatgtatgtgaacctctcccttaggagaagaacttttctttggcaaacaccataggaacggagaccttaacaaaagaattagga

SEQ ID NO: 28236 - DNA, 201 bp, Homo sapiens
aaagtactctctatggagaggttttatggttctgaaataatttaaaaacacactttactacaatccatagcaggtagttttgccaatttgggaagttatgktgccttgcagtttccaaagtaagctgaacagtgttttttaacagtgctgcccctctctcccactagaaatgcgagtccatccttttaccaagtgtggtac

SEQ ID NO: 28237 - DNA, 201 bp, Homo sapiens
aatttaaaaacacactttactacaatccatagcaggtagttttgccaatttgggaagttatggtgccttgcagtttccaaagtaagctgaacagtgttttytaacagtgctgcccctctctcccactagaaatgcgagtccatccttttaccaagtgtggtacgacaaaggtttctctggttttcttttggtattctcaga

SEQ ID NO: 28238 - DNA, 201 bp, Homo sapiens
tggtatgtgcaggtatcaccaggatgcaattagtttgatgaaatataccaagtcgtcaatgccactttggatagtttaatctgaaaataggacatggttgkggtagtgggcacaggggaaggaaggttatgtaattttaaaattcttcctttgattcaaaagaaaaaaacatgtttgttgcattcaactccaaagggtgag

SEQ ID NO: 28239 - DNA, 201 bp, Homo sapiens
gaaattgtctctaccttcaaggttctcacagtctggagggaacagagagccatcagggacaataggtccctgtgccatcagctactgggatgtatgacttyccagtagaggtacacagcacttgttccaaaaggagcctatgtagctttgggagttctctatttagtcaccttattttttttgtcttcttgttaaactagc

SEQ ID NO: 28240 - DNA, 201 bp, Homo sapiens
aaagtgagattgcttcacattgcatttaaaggcttaaataatgtattctgtcagacaattctctgaaatggttttccaagtgaatgcatcagaaagtgccyagaaagaatgcctggcacaggaagaggagggcattcagaaaatgtgagctgcttgcatcagaatctaacttgagatgtatcattcctacggtaaggtgca

SEQ ID NO: 28241 - DNA, 201 bp, Homo sapiens
atagttttctgttcctgaattcatataaatagtcacccagtacgcattctttgctgtcttgcttcttttactcctcattaggttgtgggatttgcccacgrtatttcattctttattgtcattcttctttctctgccactgccatcctaccaacagtttgtattatgaaaaattgcagacgtacacaaaagttgaaagaat

SEQ ID NO: 28242 - DNA, 201 bp, Homo sapiens
ttttaaaaataattaaggtgatgtcatgataaggctattaagagccaacatgcattgagtatggactttctgccagacattgcactatgcacttaacacayagacacatattgttttttccattttaagatacagaaagtgggccttaaaggtgctactgacttgctgatatgctttggctgtgtccccacccaaatctta

SEQ ID NO: 28243 - DNA, 201 bp, Homo sapiens
gttttttccattttaagatacagaaagtgggccttaaaggtgctactgacttgctgatatgctttggctgtgtccccacccaaatcttaacttgaatcgtrtctcccagaattcccacgtgttgtgggagggacccagggagaggtaattgaatcatgggggctggtgtttcccatgttattcttatgaaagtgaataagt

SEQ ID NO: 28244 - DNA, 201 bp, Homo sapiens
ggagaggtaattgaatcatgggggctggtgtttcccatgttattcttatgaaagtgaataagtttcataagatccaatgaatttatcaggggtttctgcartttttctcttgccaccaccatgtaagaagtgcctttcacctccaccatgattctgagacctccccagccatgtagaactgtaagcctgattaaacctctt

SEQ ID NO: 28245 - DNA, 201 bp, Homo sapiens
acctctttttcttcccggtctcaggttatgtctttatcagcagtgtgaaaatggactaatacagtgaattggtaccagtagagtggggcattgctgaaaasatatctgaaaatgtggaagtgactttggaactgggtaacaggaagaagttagaaccgttgggaggtctcagaagaagacaggaaaatgtgggaaagtttg

SEQ ID NO: 28246 - DNA, 201 bp, Homo sapiens
cggtctcaggttatgtctttatcagcagtgtgaaaatggactaatacagtgaattggtaccagtagagtggggcattgctgaaaacatatctgaaaatgtsgaagtgactttggaactgggtaacaggaagaagttagaaccgttgggaggtctcagaagaagacaggaaaatgtgggaaagtttggagcttcctagagac

SEQ ID NO: 28247 - DNA, 201 bp, Homo sapiens
ggtggctcatgcctataatcctagcacgttgggaggctgaggtgggtggagcacctgaggtgaggagttcgagaccagcctggtcaacatggtgaaacccyatctgtactgtaaatacaaaaaattagctgggcatggtggcaggcacttgtaatcccagctacttgggaggctgaggcaggagaatcacttgaacccgga

SEQ ID NO: 28248 - DNA, 201 bp, Homo sapiens
gagcaaaactccatcttaaaaaaaaaaaaaaatgcccgccttattcagatacacagtctaatgctttccactagaagattctggcactgttagcatctctrgcataaactatgttactcaacccagttctgtcgtcgtcatttttttgtgttggctttgcccttcccgcattgtgacttgatcccatttaagcagcaacct

SEQ ID NO: 28249 - DNA, 201 bp, Homo sapiens
tctctagcataaactatgttactcaacccagttctgtcgtcgtcatttttttgtgttggctttgcccttcccgcattgtgacttgatcccatttaagcagyaacctctgcacacacaatcttttctctgtccttcactcagtgatgttataatatctagaggcttattgattatttgtttgattctattgtgggcacagga

SEQ ID NO: 28250 - DNA, 201 bp, Homo sapiens
caagccccagctgccaaggaggctgatatcgggagaggcagaatgtgtcttttctttcttcttcctcttcttcttcttctttttgaaaccatgctcattgkttttaggaatcattagcatggtgaagattaaagctattggagatagcacagattgtttcattttattatgttcaattggattggatccgagccatttgca

SEQ ID NO: 28251 - DNA, 201 bp, Homo sapiens
cttttttccactttcaaatgtataacaaaatagaactttatatttccagatggactgcctggaacccggggagtggctcagctaccaggccccagtggccsttgtcttgttatttcctccattagagacctggcgtataattgtgggagggagaagccagtggagcagtcaggggactccctggctgtttctgtgtctggt

SEQ ID NO: 28252 - DNA, 201 bp, Homo sapiens
actttatatttccagatggactgcctggaacccggggagtggctcagctaccaggccccagtggcccttgtcttgttatttcctccattagagacctggcrtataattgtgggagggagaagccagtggagcagtcaggggactccctggctgtttctgtgtctggtcttatgggtctgggcactgaattcagtcacaaac

SEQ ID NO: 28253 - DNA, 201 bp, Homo sapiens
aaggaccctatgttatatgatttcatttacatgaaataccccaaagaggcaaatctgcagaaacagaaagtagagtggttgccaggggctggggatggggygtggatggaggcatttgggattaacagctaaagatagcaggattccttctaaagcaataaaaatgttgtaaagttgattgtggaaattctttcacaactc

SEQ ID NO: 28254 - DNA, 201 bp, Homo sapiens
actttgaacactttaaatgggtgaattgtatggtatatgaatcatatctcaacaaagctgttaaaaaattgtatgaaaactgtgatgggattcaagtagtstaacgctcaaatttcccaagtgccctcatttaagtctggaccacgacaggaacccagatgtggcctgagtagcacatcgtggaatgggcctgtcacctct

SEQ ID NO: 28255 - DNA, 201 bp, Homo sapiens
tgaacactttaaatgggtgaattgtatggtatatgaatcatatctcaacaaagctgttaaaaaattgtatgaaaactgtgatgggattcaagtagtctaaygctcaaatttcccaagtgccctcatttaagtctggaccacgacaggaacccagatgtggcctgagtagcacatcgtggaatgggcctgtcacctctaccc

SEQ ID NO: 28256 - DNA, 201 bp, Homo sapiens
cggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgc

SEQ ID NO: 28257 - DNA, 201 bp, Homo sapiens
caaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattccca

SEQ ID NO: 28258 - DNA, 201 bp, Homo sapiens
tagggttcctttttttcaagttaaagcattgagtcatgtctctgataaatcgcccccccaccccgatccccaccctctgccgccccggccttctttttgtrctgttgggttccaaactttacctgaggattttcacatgcacatctgttaaatgccatttaaagagaacactaacaagagaaagctagttcatttttcttc

SEQ ID NO: 28259 - DNA, 201 bp, Homo sapiens
tttgtgctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacact

SEQ ID NO: 28260 - DNA, 201 bp, Homo sapiens
tgtttgtaacattgaatacttaagacatctgctcagagtctcgcattataaatgaatggaaaggatccaggagggctttattggatgggagccgtgaagtsagcgccgtgtatttcaaagcaggatcttaatcagacattatttatatctataatattttacaaattaaaagcagtagaaatagtcactggaaggaagtca

SEQ ID NO: 28261 - DNA, 201 bp, Homo sapiens
aacattgaatacttaagacatctgctcagagtctcgcattataaatgaatggaaaggatccaggagggctttattggatgggagccgtgaagtgagcgccrtgtatttcaaagcaggatcttaatcagacattatttatatctataatattttacaaattaaaagcagtagaaatagtcactggaaggaagtcagcaagca

SEQ ID NO: 28262 - DNA, 201 bp, Homo sapiens
taatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtgtaaatgtt

SEQ ID NO: 28263 - DNA, 201 bp, Homo sapiens
aaaaaaaataaaagaacctgaagccgccaagagaggctcactgaccatctctgggggaggaagggtgaagagtagcaaatttaccgtcatcagcaggtgtstaaatgttccatttacattgaatggcacatgtcataaagtacataccgctgcacatcccaccctctgtttctgtttcaactgcagagcctatttttcttt

SEQ ID NO: 28264 - DNA, 201 bp, Homo sapiens
cctgaagccgccaagagaggctcactgaccatctctgggggaggaagggtgaagagtagcaaatttaccgtcatcagcaggtgtgtaaatgttccatttamattgaatggcacatgtcataaagtacataccgctgcacatcccaccctctgtttctgtttcaactgcagagcctatttttctttcccttccagctcagct

SEQ ID NO: 28265 - DNA, 201 bp, Homo sapiens
ataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaat

SEQ ID NO: 28266 - DNA, 201 bp, Homo sapiens
cgtctccccgccttgtaagggctgcctgtcattttattagcgctggagcctcccgaccgaagggctgagtaattgacaaaaactgcaggtaaggcaagagrcccgtaattgattcataagatcccttcctccgatcgcattgaagagttaattatttttcctgcagttgggactcagctgttgtttccactgggattaaac

SEQ ID NO: 28267 - DNA, 201 bp, Homo sapiens
ctccccgccttgtaagggctgcctgtcattttattagcgctggagcctcccgaccgaagggctgagtaattgacaaaaactgcaggtaaggcaagagaccygtaattgattcataagatcccttcctccgatcgcattgaagagttaattatttttcctgcagttgggactcagctgttgtttccactgggattaaacagc

SEQ ID NO: 28268 - DNA, 201 bp, Homo sapiens
ttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcgggagtgggggcaccagggctcatgagcc

SEQ ID NO: 28269 - DNA, 201 bp, Homo sapiens
tcaatttgagtaatttgttcccagagaaaaagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaatt

SEQ ID NO: 28270 - DNA, 201 bp, Homo sapiens
tcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaaca

SEQ ID NO: 28271 - DNA, 201 bp, Homo sapiens
tgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagacccacacttggtctctggtgttgggtccgccagctctcca

SEQ ID NO: 28272 - DNA, 201 bp, Homo sapiens
aatgtcacccgatgcaactgtctgtcctgaagaggaggacagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagc

SEQ ID NO: 28273 - DNA, 201 bp, Homo sapiens
ggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtgga

SEQ ID NO: 28274 - DNA, 201 bp, Homo sapiens
ccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacga

SEQ ID NO: 28275 - DNA, 201 bp, Homo sapiens
cagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgt

SEQ ID NO: 28276 - DNA, 201 bp, Homo sapiens
tggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccgtaaggacccttgccatt

SEQ ID NO: 28277 - DNA, 201 bp, Homo sapiens
tgggcaagcggaggtcaagatggaattcagcctttcagacaattctgccaggcccttggagggtgggaggaaacaggcaagacctctggctcctagaaccrtaaggacccttgccattaggaccaaacctcttccagctttctcagcagccacatgtcaccccctcttccaccctttgccctgccaccctccatcccctga

SEQ ID NO: 28278 - DNA, 201 bp, Homo sapiens
gaattcagcctttcagacaattctgccaggcccttggagggtgggaggaaacaggcaagacctctggctcctagaaccgtaaggacccttgccattaggascaaacctcttccagctttctcagcagccacatgtcaccccctcttccaccctttgccctgccaccctccatcccctgataccctcctgccttttagttgc

SEQ ID NO: 28279 - DNA, 201 bp, Homo sapiens
ccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaac

SEQ ID NO: 28280 - DNA, 201 bp, Homo sapiens
ctgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcg

SEQ ID NO: 28281 - DNA, 201 bp, Homo sapiens
aaagtctgtaccaattaagcagctactacccattcctcttccctaccattctaccttctgtctcagtaggtttgcctatttgggatattttatttaagtgsgatcatacaatagcatcatgtgttcaaggttgacccacattgtggcatgtatcagtacttcattcccttttatcactgaatagtattccactgtatattg

SEQ ID NO: 28282 - DNA, 201 bp, Homo sapiens
tgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccac

SEQ ID NO: 28283 - DNA, 201 bp, Homo sapiens
atgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttagg

SEQ ID NO: 28284 - DNA, 201 bp, Homo sapiens
agttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaa

SEQ ID NO: 28285 - DNA, 201 bp, Homo sapiens
tcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatgg

SEQ ID NO: 28286 - DNA, 201 bp, Homo sapiens
gaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggtt

SEQ ID NO: 28287 - DNA, 201 bp, Homo sapiens
ctttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatt

SEQ ID NO: 28288 - DNA, 201 bp, Homo sapiens
tacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccat

SEQ ID NO: 28289 - DNA, 201 bp, Homo sapiens
tccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaa

SEQ ID NO: 28290 - DNA, 201 bp, Homo sapiens
aggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaa

SEQ ID NO: 28291 - DNA, 201 bp, Homo sapiens
ccccaatcgatcagtggagaaacgagctctggtgggcagtcaggcaaagcagatacacgtgcttcttttcagctttgttggaaggtttcattttgcttcasgaactaggcaggagaattcctgagttcctgtacaacctgagttctctgttaaaacaaggaggaagtaatcatcctgagttcgatgattcagagtaagcca

SEQ ID NO: 28292 - DNA, 201 bp, Homo sapiens
tcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtg

SEQ ID NO: 28293 - DNA, 201 bp, Homo sapiens
tctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttga

SEQ ID NO: 28294 - DNA, 201 bp, Homo sapiens
agcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaa

SEQ ID NO: 28295 - DNA, 201 bp, Homo sapiens
gtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaa

SEQ ID NO: 28296 - DNA, 201 bp, Homo sapiens
agagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctg

SEQ ID NO: 28297 - DNA, 201 bp, Homo sapiens
acgaaactcacatcttctttaaataaaatctccatttagaaatttttgaagacttgtggatagaagaagtaaccttgaaaagggcagagctgagccagacmccttttcagctgggtgctccctggaagatggatcttgccttgtggatgtttttctaccgtgacagaagatagaaaggatgaaatagaaagagtgtgagtg

SEQ ID NO: 28298 - DNA, 201 bp, Homo sapiens
cgaaactcacatcttctttaaataaaatctccatttagaaatttttgaagacttgtggatagaagaagtaaccttgaaaagggcagagctgagccagaccmcttttcagctgggtgctccctggaagatggatcttgccttgtggatgtttttctaccgtgacagaagatagaaaggatgaaatagaaagagtgtgagtga

SEQ ID NO: 28299 - DNA, 201 bp, Homo sapiens
tgcctcagcctcccgagtagctgggattacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaaca

SEQ ID NO: 28300 - DNA, 201 bp, Homo sapiens
cagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtc

SEQ ID NO: 28301 - DNA, 201 bp, Homo sapiens
gcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattt

SEQ ID NO: 28302 - DNA, 201 bp, Homo sapiens
gcgatttaatttgctgctgaatgcacttttgaataaagggcctagaagatgcagtctcgaggaaccgaggccggttagagacaggctggcagctttgcctyctctcccaagacaaaggcctccccgcccccctaaatccagcacacaatcagctgctctccctccccctattctcagcaggagagtcaggatgcatatttc

SEQ ID NO: 28303 - DNA, 201 bp, Homo sapiens
tgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataa

SEQ ID NO: 28304 - DNA, 201 bp, Homo sapiens
ttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgac

SEQ ID NO: 28305 - DNA, 201 bp, Homo sapiens
caggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcacccggcccctgcctttttattttgctaaacctgatgacccttgccatag

SEQ ID NO: 28306 - DNA, 201 bp, Homo sapiens
tttgacatgttgccaggctgctctcgaactcctgacctcaggtgattcacctgccttggcctcccaaagtgctgggattacaggtgtgagccaccgcaccyggcccctgcctttttattttgctaaacctgatgacccttgccatagcagaactaaagtgatgatgatgattacagcagatcagttattttgagctctgac

SEQ ID NO: 28307 - DNA, 201 bp, Homo sapiens
gtgtgagccaccgcacccggcccctgcctttttattttgctaaacctgatgacccttgccatagcagaactaaagtgatgatgatgattacagcagatcarttattttgagctctgactttgcatgaggccctttattaagtgcttcacttgtgtgatctgatttaatcttcacaagcaaactgggacagagggactgtgc

SEQ ID NO: 28308 - DNA, 201 bp, Homo sapiens
cggcccctgcctttttattttgctaaacctgatgacccttgccatagcagaactaaagtgatgatgatgattacagcagatcagttattttgagctctgastttgcatgaggccctttattaagtgcttcacttgtgtgatctgatttaatcttcacaagcaaactgggacagagggactgtgcctattcccatttcacag

SEQ ID NO: 28309 - DNA, 201 bp, Homo sapiens
ttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaat

SEQ ID NO: 28310 - DNA, 201 bp, Homo sapiens
gttccctgtactctgcaatgctgagtacttctcatccttcaggtctactgcaagtgtcacctggccaacacaccatgccttcccagtctctggtgttactstctgcatactgtagaccatcatcttgtttgcatacttgtctgttatctctttatcatccttctacccacatcaggcaattccaagagagaagaccactgg

SEQ ID NO: 28311 - DNA, 201 bp, Homo sapiens
agtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggc

SEQ ID NO: 28312 - DNA, 201 bp, Homo sapiens
tttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgca

SEQ ID NO: 28313 - DNA, 201 bp, Homo sapiens
gccatctctgcctctgtcttctcaccaccatcttccttgtccatgtctctctatgtcttcaatgttcttcttataaggacaccagtccttggatttagagyccaccctaattcactgtaatcacatcttacctaagtccatctgcaaagaccctatttccaaataaggtcacattctgaggccctgggtggacatgcattt

SEQ ID NO: 28314 - DNA, 201 bp, Homo sapiens
tttaaggacctttgtgatagttttgcacccactggatgacccagaatcatcttcctcttttaagatcagctgattagcaacgtcagttccacccacaatcytcatttccctttgttgcgtaacctaacatattcacaggttctggtgagtgggatgggggtatctctaggggaccattatccagccttccacaggcacttt

SEQ ID NO: 28315 - DNA, 201 bp, Homo sapiens
gatagttttgcacccactggatgacccagaatcatcttcctcttttaagatcagctgattagcaacgtcagttccacccacaatcttcatttccctttgtygcgtaacctaacatattcacaggttctggtgagtgggatgggggtatctctaggggaccattatccagccttccacaggcactttgtcacaggccaggcg

SEQ ID NO: 28316 - DNA, 201 bp, Homo sapiens
ttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttactaacagaattcattttcttgtaactgtaggactgaggtgctt

SEQ ID NO: 28317 - DNA, 201 bp, Homo sapiens
ggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgt

SEQ ID NO: 28318 - DNA, 201 bp, Homo sapiens; identical to SEQ ID NO: 4895

SEQ ID NO: 28319 - DNA, 201 bp, Homo sapiens; identical to SEQ ID NO: 4907

SEQ ID NO: 28320 - DNA, 201 bp, Homo sapiens; identical to SEQ ID NO: 4906

SEQ ID NO: 28321 - DNA, 201 bp, Homo sapiens
cctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggca

SEQ ID NO: 28322 - DNA, 201 bp, Homo sapiens
attgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttatt

SEQ ID NO: 28323 - DNA, 201 bp, Homo sapiens
tctctgtgagccctttgaggatggatgtgtgtccatcttgttaacagttggctccccagtaaccagtacagtgccagatacagagtagtaaccctacattstagcgtaggcaaatattctagtatttgccaaaactagaggatgaatgagtgatgggtaagagagttctcagaaaaatggatataaacaatattgtaaatc

SEQ ID NO: 28324 - DNA, 201 bp, Homo sapiens
tgtttatgtaagatccataatgactcttgccaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggat

SEQ ID NO: 28325 - DNA, 201 bp, Homo sapiens
aagggaaggatggaaggaagagagggagagacggagggagatggaggatgacagggagatggagggaggcaaaaagaaaaagggagaaggaaagagaggaragaggggaagggaggaaggaaagaagagagagaaggaggaagagagggaaggaggcacagaggtagagaggcagggagataatggagatcctggccaaaa

SEQ ID NO: 28326 - DNA, 201 bp, Homo sapiens
gcagaatggaagggaaggatggaaggaagagagggagagacggagggagatggaggatgacagggagatggagggaggcaaaaagaaaaagggagaaggawagagaggaaagaggggaagggaggaaggaaagaagagagagaaggaggaagagagggaaggaggcacagaggtagagaggcagggagataatggagatcc

SEQ ID NO: 28327 - DNA, 201 bp, Homo sapiens
aagcagaatggaagggaaggatggaaggaagagagggagagacggagggagatggaggatgacagggagatggagggaggcaaaaagaaaaagggagaagkaaagagaggaaagaggggaagggaggaaggaaagaagagagagaaggaggaagagagggaaggaggcacagaggtagagaggcagggagataatggagat

SEQ ID NO: 28328 - DNA, 201 bp, Homo sapiens
aatatatggctttttcctattggaaaaaattagtcgtgtgaactttattcttcaagaaaaagtagtttttatctgccttggaaatgtcaaaaggattcacragtttcacaagtgatgatctgggttgattgctaggaactgtttttagttagtttttttttttttttttttttttcagacggagtcttgctctgttgccca

SEQ ID NO: 28329 - DNA, 201 bp, Homo sapiens
cctaaggtcccagccacctatggttctttggacctgtgattttcgctgaccccgaatgactggaggaactgctgcctgcatccccaacccagccctccttrtcagtcacgtagaaagcagttattgtttccaagttccctgcccttgttaaatgtcagctttgagtgaaaatgttcctaattttactcagagtgcaaagaa

SEQ ID NO: 28330 - DNA, 201 bp, Homo sapiens
tggcaacctttggtgtttggggcatgttgtcacctcattgccatctctgcctctgtcttctcaccaccatcttccttgtccatgtctctctatgtcttcartgttcttcttataaggacaccagtccttggatttagagcccaccctaattcactgtaatcacatcttacctaagtccatctgcaaagaccctatttccaa

SEQ ID NO: 28331 - DNA, 201 bp, Homo sapiens
cagtcacagaaatgaggtagctgtagccaaggatgatggcatagcacattcgtttcttaggcgtgccacgtactaggtggcttcagtcagcagaactgtaytttcccacagttttggaggctcaaatttgcaagtcgaggtttcggcaaggccatcctctctctgaaaactctatgggggcgtcctctttgcctcttcccg

SEQ ID NO: 28332 - DNA, 201 bp, Homo sapiens
tccccaggctaagcacagtcacagaaatgaggtagctgtagccaaggatgatggcatagcacattcgtttcttaggcgtgccacgtactaggtggcttcastcagcagaactgtattttcccacagttttggaggctcaaatttgcaagtcgaggtttcggcaaggccatcctctctctgaaaactctatgggggcgtcct

SEQ ID NO: 28333 - DNA, 201 bp, Homo sapiens
aatggcatctatgatcttagatttagtaaaacgcagtatcttcttccccagctgaaatagcgaaagggtctcttcaggctcctgggataaaaaccaggatscttcatgtgtctgagcaggcttcccaccatttgactgctgctcctttgtccagacacatttaacaccatctccctgcaccccttcactgggctccgaagc

SEQ ID NO: 28334 - DNA, 201 bp, Homo sapiens
ccctggaagatggatcttgccttgtggatgtttttctaccgtgacagaagatagaaaggatgaaatagaaagagtgtgagtgaattctgcacccacccccvccccccagcttccccacctgtaaaatgatttgctcaaagtttgcaaagaatggaggcatattcaaagtgctcagcactgggccggacccatgggtatgaa

SEQ ID NO: 28335 - DNA, 201 bp, Homo sapiens
taaatattttaatgtttgtcgtttgtttgcaaccttgtaattttttcctgtgcagcaattttaactttctatattcaaatatactctgaatgcacagtgartttggcagaataccatttaagtcttgtattttccaaagctagtcaacgtccaactgccaatgttgcctgaacaggaaatatttatacctgaaagcgtcca

SEQ ID NO: 28336 - DNA, 201 bp, Homo sapiens
gtttggggcatgttgtcacctcattgccatctctgcctctgtcttctcaccaccatcttccttgtccatgtctctctatgtcttcaatgttcttcttatarggacaccagtccttggatttagagcccaccctaattcactgtaatcacatcttacctaagtccatctgcaaagaccctatttccaaataaggtcacattc

SEQ ID NO: 28337 - DNA, 201 bp, Homo sapiens
tgcttgaacctgggaggcagaggctgcagtgagtcgagatcacaccactgcactccagcctgggcgacagagtgaaactctgtctcggaaaaaaaaaaaaaagagtttaattcatgcagagctggctgtgtgggagaccagagttttattattactcaaataagtctcccccaaaactcagggatagagatttttaaggag

SEQ ID NO: 28338 - DNA, 201 bp, Homo sapiens
ttaatatcctcaaattaaaacatacgtttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgacct

SEQ ID NO: 28339 - DNA, 201 bp, Homo sapiens
ggctgggcacggtggctcactcctgtaatcccagcactttgggaggccaaggcagatgggtcacctgaggtctggagttccagaccagcctgaccaatatwgtgaaaccccatctctactaaaaatacaaaaagttagccgggcgtggtagcacacacctgtaatcccagcaactcgggaggctgagacaggagaattgct

SEQ ID NO: 28340 - DNA, 201 bp, Homo sapiens
gaaatctctagcttctcaaactgtttcgtggtggagtgccttttgggcacaggagaaggaaataagagcctcgcgaggtttgggaatgctgcctctagctytcacactgcatgcagaattcctactctgagagctcactttatctcaaaaacccatgcatattctgcatctactctgaattccgcagtgttgtgtgttact

SEQ ID NO: 28341 - DNA, 201 bp, Homo sapiens
gtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcaga

SEQ ID NO: 28342 - DNA, 201 bp, Homo sapiens
atatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctct

SEQ ID NO: 28343 - DNA, 201 bp, Homo sapiens
ggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtag

SEQ ID NO: 28344 - DNA, 201 bp, Homo sapiens
ggcaccacacacgatgagattggaggcacctgggtgtcagcctcttgggctggctcattacaggccactctgtctgaggaacactcaggtttgcaaaccgkttcttaaaattacaggatacctagggacctgttggggtgggagggaagaaccctatgggcagaaatgtgactttctgtagcaaagatgtactgtttccca

SEQ ID NO: 28345 - DNA, 201 bp, Homo sapiens
cagttgctcacactcggtcaatacttgccttcctttgaggccatctgcactcactgacaatctgatcgctcccctgaatggaggtgaaagcatgcaagctmggagttaagatctttaactcagggaagaccctgtctatggaagtgctgagctcttcagtgtcatcacagaaaagcatgagcccctccctggtacggagtc

SEQ ID NO: 28346 - DNA, 201 bp, Homo sapiens
aatctctagcttctcaaactgtttcgtggtggagtgccttttgggcacaggagaaggaaataagagcctcgcgaggtttgggaatgctgcctctagctctyacactgcatgcagaattcctactctgagagctcactttatctcaaaaacccatgcatattctgcatctactctgaattccgcagtgttgtgtgttactat

SEQ ID NO: 28347 - DNA, 201 bp, Homo sapiens
tttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttc

SEQ ID NO: 28348 - DNA, 201 bp, Homo sapiens
acgaaggaggaggaggaggaaaaggtgacttgcctctagctgatgtggattatttctcttttttaatttccatgtctgcgtagcttcatcatagatctcarcttaaggacaatgaaagtcgtttattgagtacttagtatgtgctggttgcagagccaagtcttttttttttttttttttttcctccttttttgagagaga

SEQ ID NO: 28349 - DNA, 201 bp, Homo sapiens
tgccatccacggacggcttaagtgttaacagttcagtggagggtcagcgtgacagccttttgcacccacatctgggttcttgtccagtgtccaggaggaaygaggtctcatgagcaaattttaaggatggcaaatgtgggggattttattgctgatgaaagtggctttcactgggaagataagctaaaaagaagacaaagc

SEQ ID NO: 28350 - DNA, 201 bp, Homo sapiens
tttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgac

SEQ ID NO: 28351 - DNA, 201 bp, Homo sapiens
tctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagcct

SEQ ID NO: 28352 - DNA, 201 bp, Homo sapiens
agcaacacacaaggattgggagatgttcatggcaagaaaaattcagaagggacattgttgtttcactaattctgtaaaggagagcagcggcatttacttakgccgattccccattctctctttctgtttttaaacagagacagatcttgctctgttgcccaggctggagtgcagtggcatgatggcatgatcatagttcac

SEQ ID NO: 28353 - DNA, 201 bp, Homo sapiens
gaggtggtagatgcttttaaacaaacagatctcaggagaactctttcacaagacagcactagggggatggtgattagaaagcacctcatgatcccgtctasttcctgcagagaacagactagccccctatgcagcacacacctttgtgaggtccctcctccaacacagggattacaattcaacctgagacgtgggtgggga

SEQ ID NO: 28354 - DNA, 201 bp, Homo sapiens
tataatttttttcttcttttctatctgctagcaaagtgggtaagttgacccatgacatggtccactggagggaccacatttgtgactctagcaattaagcytcccttctcatctgtggataaaactgacctcccagtgtgctggagtcaaacatattcagcatccaatccacattggactgtttgcatgtaacgtacagaa

SEQ ID NO: 28355 - DNA, 201 bp, Homo sapiens
agttccattaggtgacagtgtgtgcacagtttatggaggatgaagcggaaaacctgagccacaaggcagtagaggttggacgagacactcattccgaaggsgggtgtgtatgtgcaaactgtataatttttttcttcttttctatctgctagcaaagtgggtaagttgacccatgacatggtccactggagggaccacatt

SEQ ID NO: 28356 - DNA, 201 bp, Homo sapiens
gtggcgtttccacacacagggaagcagatagttccattaggtgacagtgtgtgcacagtttatggaggatgaagcggaaaacctgagccacaaggcagtakaggttggacgagacactcattccgaaggcgggtgtgtatgtgcaaactgtataatttttttcttcttttctatctgctagcaaagtgggtaagttgaccc

SEQ ID NO: 28357 - DNA, 201 bp, Homo sapiens
aagatgagtggcgtttccacacacagggaagcagatagttccattaggtgacagtgtgtgcacagtttatggaggatgaagcggaaaacctgagccacaakgcagtagaggttggacgagacactcattccgaaggcgggtgtgtatgtgcaaactgtataatttttttcttcttttctatctgctagcaaagtgggtaag

SEQ ID NO: 28358 - DNA, 201 bp, Homo sapiens
tcacagtgtttctagctcccctttccaatacatctctctctctctttctctctctctctctctctctctcacacacacacacacacacacacacacacagscaaatcagacaccaacataaactgtagagttaacattctttttccaccctcacactttttttagctccgatctgtgttcaatttctgcctgagagagtga

SEQ ID NO: 28359 - DNA, 201 bp, Homo sapiens
aaatttgccgggtgtagtggtgcacacctgtagtcccagctatttggaaggctggggcaggagaatcgcttgaacctgggaggcagatgttgcagtgagcygagatcaggccactgcactccaacctgggtgacagagccagagtctgtctcaaaaaacgaaaaacaaaaaaaaccaaaagactaaatgtataaaaggtac

SEQ ID NO: 28360 - DNA, 201 bp, Homo sapiens; identical to SEQ ID NO: 8511

SEQ ID NO: 28361 - DNA, 201 bp, Homo sapiens
cctggcttggtgtgttttgtggcatttggcaggcaaacgttttgaaaagaaatctcctttcaaaaatcacagcactggttgaagcaggagcatctctcccyttaaatgcaaaaggagttaatatgccagtgactacagtgtgcctggaaaggtcactggaggcatttttgtctggggcagcccctggagtcttggcttttg

SEQ ID NO: 28362 - DNA, 201 bp, Homo sapiens
tacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgt

SEQ ID NO: 28363 - DNA, 201 bp, Homo sapiens
ccactgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatc

SEQ ID NO: 28364 - DNA, 201 bp, Homo sapiens
cctgattgagtaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccactgaccactctctgta

SEQ ID NO: 28365 - DNA, 201 bp, Homo sapiens
ctaaagtcagttacataaccaagcccagcttcagaagggaaattgtatgccttacaaggaggtgagaggatggaaaatgaatatttgctgaacagactttytgtccagtttgttgtatttggtggtggtgcagggcaaatatatgtttaaaaccttgttcagatttttagctttcttcagaacagagcttttaaaactgag

SEQ ID NO: 28366 - DNA, 201 bp, Homo sapiens
cgatgagattggaggcacctgggtgtcagcctcttgggctggctcattacaggccactctgtctgaggaacactcaggtttgcaaaccgtttcttaaaatwacaggatacctagggacctgttggggtgggagggaagaaccctatgggcagaaatgtgactttctgtagcaaagatgtactgtttcccactgagaagaat

SEQ ID NO: 28367 - DNA, 201 bp, Homo sapiens
aaactggctgactgagttaaatgaatgccaaagtcacagagctgctgagtggcagagttgtaattcccatgcagaactgtgtggcatcaaagccatttttwaactcattgcaatgcacagtgggttaaaatgagatgattgaaaatgagatgtggctgggcatggtggctcacacctctaattccagcactttgagaggat

SEQ ID NO: 28368 - DNA, 201 bp, Homo sapiens
ctgtttgaagcactgtattgagcataccatatgctgaaagacttggaatgcaaaaacctaaggccaagggcacttctcaatattaaaccctcagttgtaakggaggcatcaagactataagatccaagaccttaacttttgtgctccttgtcttgtggagggaacatccatcctcaaaacagaaacctgtgagatcccttg

SEQ ID NO: 28369 - DNA, 201 bp, Homo sapiens
tggccaaattctgtttgaagcactgtattgagcataccatatgctgaaagacttggaatgcaaaaacctaaggccaagggcacttctcaatattaaacccycagttgtaatggaggcatcaagactataagatccaagaccttaacttttgtgctccttgtcttgtggagggaacatccatcctcaaaacagaaacctgtg

SEQ ID NO: 28370 - DNA, 201 bp, Homo sapiens
tcaagtgatcctcctgccttgagctcccgaagcgctgggaccaatagagatttctctgagaattaggtcccccactattaataaggtcattgtcagctgarttggggaggtggcgtgggtagatacaattaatttagattttttaaaaggcttttgagaatattcggagaacctaatatattttgagacctgacatttatt

SEQ ID NO: 28371 - DNA, 201 bp, Homo sapiens
cccacctcagcctgagtagatgggactacaggcatgtgtcaccatgccaggctaatgtttaaaaatttttcttagaggtagagcctcactttgctgcctargctgatctagaactcctggcttcaagtgatcctcctgccttgagctcccgaagcgctgggaccaatagagatttctctgagaattaggtcccccactatt

SEQ ID NO: 28372 - DNA, 201 bp, Homo sapiens
tgctgggaatgcgttcattttctttatcttgccattactgtacctctattgggaaatttactctctcttcatagataggatccgattcagtacatatttakaaaaccacacttacatttaaatacaggcctttcccatttcacagtgtttctagctcccctttccaatacatctctctctctctttctctctctctctctc

SEQ ID NO: 28373 - DNA, 201 bp, Homo sapiens
tggtggggaaggatgttgcggtggggttggggtggcaatgaaaggtgaaaaccactgtggtcccacctgcccatcgtcagatttcggttcctctcagagtyaacgtagaaggtttctgggggcatggacctgagtcttatcccctttgcaaaagtaagaattgtatcgtagcctgactcagggttttagccaacttctctg

SEQ ID NO: 28374 - DNA, 201 bp, Homo sapiens
ttgaaggtgacagagactgagaaagggctgcacacctttggcctaaagggtaatgagcaacacacaaggattgggagatgttcatggcaagaaaaattcasaagggacattgttgtttcactaattctgtaaaggagagcagcggcatttacttaggccgattccccattctctctttctgtttttaaacagagacagatc

SEQ ID NO: 28375 - DNA, 201 bp, Homo sapiens
tctttccccctcaacttccataggaaccaaactctctttcttcctcccgtttggttggaaagttattttgcctcactgcgtgatttttctactgcaccaaytcccctttcaaacgttattccacaacatactaaattaatgtatactgtgttctttgggtaatggggaggggagcctgtctcacagcacgcatttgttcag

SEQ ID NO: 28376 - DNA, 201 bp, Homo sapiens
ccttttgactccctaaggaaccctgttttgggtttcttttgaggttgaagatatttcagactctttccccctcaacttccataggaaccaaactctctttmttcctcccgtttggttggaaagttattttgcctcactgcgtgatttttctactgcaccaactcccctttcaaacgttattccacaacatactaaattaat

SEQ ID NO: 28377 - DNA, 201 bp, Homo sapiens
gtgcaggttagaggctatgtcagaagcaagtcaggatttgaaggcagatctgtctgcttttgcccctctgtaaatccagagctgctgcctcatttcttacrttgcccccacccgtgcagcaattcttcctgggaggcctcattgttcatattcataaagggccccattcagtctcctttttggagaaatggccactgcaac

SEQ ID NO: 28378 - DNA, 201 bp, Homo sapiens
acatcttcccctttcttctcccccaggtttgtcccatttgtactgactctgacccaggttgtcatgacttgagactcactagaagtttcagaaagatgcasactgctttaaaaaaaaaaaaaaagggcaaggggaggtgtgagaagaaagtataattctttttcttctaactggagatataaaaatcatataagcatgatt

SEQ ID NO: 28379 - DNA, 201 bp, Homo sapiens
agggccacatcttcccctttcttctcccccaggtttgtcccatttgtactgactctgacccaggttgtcatgacttgagactcactagaagtttcagaaaratgcagactgctttaaaaaaaaaaaaaaagggcaaggggaggtgtgagaagaaagtataattctttttcttctaactggagatataaaaatcatataagc

SEQ ID NO: 28380 - DNA, 201 bp, Homo sapiens
ccaccagccttggcctcccaaagtgctgggattacaggcattagccaccacacccggcccaaattttcttataaagtcaaatgggagatacttgtttgcargaaatagttcttttggttcttacttttccataaggattgagtctcaaaatgtctggtagcatccactgcattttgtaggggacaataacaaagaagatgc

SEQ ID NO: 28381 - DNA, 201 bp, Homo sapiens
tcttctccctctccgttaaaatgcaacttaattggtaaagtttagttgactagagatttcatttatttatttatttatttatttatttatttatttgtttrtttgtttgtttgagatgagtcttgctcttttgcccaagctggagtgcagtggcatgatctcggctcactgcagcctctgcctcccgtgtccaagtgattc

SEQ ID NO: 28382 - DNA, 201 bp, Homo sapiens
atgttataggcagttctgaaggaaaggattcgatgactatctttttttggcacaaatgtgatccttctggaggccagaagatagattcagtgggccccagwtctttcaggtttaaggaataagcattttggtctatgaaaaatggggtttgcctaaagtataagattgtcttatatttataaatgcctgtgttcattgctg

SEQ ID NO: 28383 - DNA, 201 bp, Homo sapiens
gccaaattgaagggtaaactgagttcaccaggcaaactgaggaagggtactcaggctgaaggatcatgggaggggaggagcgtgagttcctcttaagtgartataaaccagggggtaggaaacaacatgagatgaggctggcgagagagaaggatgctaggtgaggtgctgtggtgcgccagagactgcggaagtggcttt

SEQ ID NO: 28384 - DNA, 201 bp, Homo sapiens
ggccccctgcatctcaaagccagcaacagaaactctcttgtgcatggagtcccctcctgctttgaatctctctgactttccttgactttgatgtctaggtytggatttcaagggctcagaaactctctcatgcatgtagttccctcctgctttgaatctctctgactttccttgattttgatgtctaggtctggatttcaa

SEQ ID NO: 28385 - DNA, 201 bp, Homo sapiens
acttttggccccctgcatctcaaagccagcaacagaaactctcttgtgcatggagtcccctcctgctttgaatctctctgactttccttgactttgatgtytaggtctggatttcaagggctcagaaactctctcatgcatgtagttccctcctgctttgaatctctctgactttccttgattttgatgtctaggtctgga

SEQ ID NO: 28386 - DNA, 201 bp, Homo sapiens
cctgagtagatgggactacaggcatgtgtcaccatgccaggctaatgtttaaaaatttttcttagaggtagagcctcactttgctgcctaggctgatctaraactcctggcttcaagtgatcctcctgccttgagctcccgaagcgctgggaccaatagagatttctctgagaattaggtcccccactattaataaggtca

SEQ ID NO: 28387 - DNA, 201 bp, Homo sapiens
tgcagactgtataggcttctgcctctcgggaggcctcaggaaacttacagttatggcagaaggtgaaggggaagcaggtaatgtcttcacatggctggcastggaggaagagagaaagtagggaggtggtagatgcttttaaacaaacagatctcaggagaactctttcacaagacagcactagggggatggtgattagaa

SEQ ID NO: 28388 - DNA, 201 bp, Homo sapiens
acgagacactcattccgaaggcgggtgtgtatgtgcaaactgtataatttttttcttcttttctatctgctagcaaagtgggtaagttgacccatgacatsgtccactggagggaccacatttgtgactctagcaattaagcctcccttctcatctgtggataaaactgacctcccagtgtgctggagtcaaacatattca

SEQ ID NO: 28389 - DNA, 201 bp, Homo sapiens
acaaggcagtagaggttggacgagacactcattccgaaggcgggtgtgtatgtgcaaactgtataatttttttcttcttttctatctgctagcaaagtggrtaagttgacccatgacatggtccactggagggaccacatttgtgactctagcaattaagcctcccttctcatctgtggataaaactgacctcccagtgtg

SEQ ID NO: 28390 - DNA, 201 bp, Homo sapiens
gggaagtggaggttgcagtgagccgagatcttgccattgttctccagcctgggcgacaagagtgaaactccatctcaaaaaaaaaaaaaaaaaaaaaaaarattatgtcatttcgttgtcacagcgtcagcagaataaatcttagatcaagatgggattactgcgccactcccttcttcccagtctgtggtttagcacggg

SEQ ID NO: 28391 - DNA, 201 bp, Homo sapiens
agactcactagaagtttcagaaagatgcagactgctttaaaaaaaaaaaaaaagggcaaggggaggtgtgagaagaaagtataattctttttcttctaackggagatataaaaatcatataagcatgatttatgatttgattggaacattgtattttatggttgcagagcacacgtatcatcctatctgcttctgacaccc

SEQ ID NO: 28392 - DNA, 201 bp, Homo sapiens
ggaggcctcaggaaacttacagttatggcagaaggtgaaggggaagcaggtaatgtcttcacatggctggcactggaggaagagagaaagtagggaggtgstagatgcttttaaacaaacagatctcaggagaactctttcacaagacagcactagggggatggtgattagaaagcacctcatgatcccgtctacttcctg

SEQ ID NO: 28393 - DNA, 201 bp, Homo sapiens; identical to SEQ ID NO: 4974

SEQ ID NO: 28394 - DNA, 201 bp, Homo sapiens; identical to SEQ ID NO: 4973

SEQ ID NO: 28395 - DNA, 201 bp, Homo sapiens
tctctaacatgcacatggccagaaaaatagcttggacattctgttcaaccctccacatcaactggtcagtttagtctttaaaaggtgataggcctgttgtsgtggctcacgcctgtaatcccagcactttgggaggctgaggcaggtggatcacttgagccccggagttgaagaccagcctgggcaacacggtgaaactaa

SEQ ID NO: 28396 - DNA, 201 bp, Homo sapiens
acacaaaacccagcgtggtgattttggcagccttgccatgcatctctaacatgcacatggccagaaaaatagcttggacattctgttcaaccctccacatsaactggtcagtttagtctttaaaaggtgataggcctgttgtggtggctcacgcctgtaatcccagcactttgggaggctgaggcaggtggatcacttgag

SEQ ID NO: 28397 - DNA, 201 bp, Homo sapiens
aatttctttcagaagtcagtactggacattcccttatttcaccttgagctacacatcccatagtcagcttagccctgtccctggtgcgggggagcaggackgttgcctgtatcccttagtcattgccgcaggcttgctgcatcacaaaccaccattagacctcagtggcccgcagcaataaacattcgattctcgccatct

SEQ ID NO: 28398 - DNA, 201 bp, Homo sapiens
agatcgcgccactgcactgcagcctgggcgacagtgaaacttttgtctcaaaaacaacaacaacaacaacaacaaacaaacaagaaacaaaaaatacataraagaggccttctcttcacaagtttttcttattgttttttgtttttttaagggaggaaatttctttcagaagtcagtactggacattcccttatttcacct

SEQ ID NO: 28399 - DNA, 201 bp, Homo sapiens
acggcagtctcaggtttatgtattaggaagcattcagcaggcaggagcagccgatctgagactggcatgggcagtggagacatcattcatctcctgaaacrtaatttggaggagactgttccagggctggctgagtgactccttgatgtcagcactttgccctgtcgtggtcttggcctttctcttgtgttccccagatgg

SEQ ID NO: 28400 - DNA, 201 bp, Homo sapiens
atgaactcatgggaagcaaacacacaccctccctccgatccaccaggcactcgggtttcctgtgtgtctggtgatgtgctgggtgttgtggatctggactsaacggcagtctcaggtttatgtattaggaagcattcagcaggcaggagcagccgatctgagactggcatgggcagtggagacatcattcatctcctgaaa

SEQ ID NO: 28401 - DNA, 201 bp, Homo sapiens
caaggacataaacatttactcctgtggtgttatgatatatatagggttcctggctcataactctcatagcccttgttgcagtctattgttacaatattgcstgtgttaggcatcaggaaacagaatctctttgtctcctgtccttctttcacctgccccaaggcaggactctaatctttcccacctttttgattgtgagtc

SEQ ID NO: 28402 - DNA, 201 bp, Homo sapiens
aaatcctttgcaaacattttctctcaatctatgggtaggcttttttactctttttatagtgtcttttgatgaacaaagattttaaatcttgatgaagtccmctttatctattttggatgttgttgcttctgtttttggtgttgtatctaagaatccattgccaaatccaaggacataaacatttactcctgtggtgttatg

SEQ ID NO: 28403 - DNA, 201 bp, Homo sapiens
ttaactttcagaggagccaccaaattgttttccacggaggctgcaccattttatatttccacttgcagtatatgaaggttccaatttctccacatccttgmcaacactttattttctgttttctttgaaggtatgaaattgtatcgtggttttgatttgcatttccctcatgattaatgatgttgagtatttttatgtggt

SEQ ID NO: 28404 - DNA, 201 bp, Homo sapiens
agccttcatctgttttcctgcagatgcccggctcgtggttaacccaagcaagaggtagttaaacggccccgcagattgccagtgactccgggaatgcctargtttatgtatggattaacacagtgatagaccctgagtagcaaaagacgaagactaattacctgacagagctcccctccactcgcctgggtcattgaaatt

SEQ ID NO: 28405 - DNA, 201 bp, Homo sapiens
acaccagactaatgcttctgacttttccatggtgccccagcagcaggctggagggaagggcgggggcggtcagaggagagatagagcacttcagattccamtcgaatacattagagcattagagcttttctcttcctcagggtgctctctctctctgggttgggaggagatgtggcatttctaggaattcacagtaaaatc

SEQ ID NO: 28406 - DNA, 201 bp, Homo sapiens
agcattcacacaggcactaagacggtgagtactcactacttagcgctgtcaacatcatctccgtccacatcaatgtcgtcatcgtccttatgaaaagccckgggcatcattttgcccttgagctggatgtccatgttggaaaaacagctagtggaaggcgtgcccaaatctcagaagttggcgtttccttgcagatatcat

SEQ ID NO: 28407 - DNA, 201 bp, Homo sapiens
ttggttatttctttattcaagggttgttgagaggatgaagtgctaaaaatgcttgaccagcattcacacaggcactaagacggtgagtactcactacttakcgctgtcaacatcatctccgtccacatcaatgtcgtcatcgtccttatgaaaagccctgggcatcattttgcccttgagctggatgtccatgttggaaaa

SEQ ID NO: 28408 - DNA, 201 bp, Homo sapiens
gctcttatttttaagtcatccttatctctttcacttattccctcattcaggcaccaaaaatgctgtttgactgggagagcaagtggagctgttcaaagttstagggacagccgggcgcagtggctcatgcctgtaatcccagcactttgggagggcgaggcgggcagatcacaaggtcaggagttcgagaccagcctggcc

SEQ ID NO: 28409 - DNA, 201 bp, Homo sapiens
gccaaaatattcttttcaaagtgattagaagtaggagaagcttgctctctttttattggcacttctgtcttacatgcactttttgattgaaattattctgkcttctatgaaatgacagtgattggaggtggtttatttttttttaagtctgcttactcggaaaaataaaacaaagttgacaacctgatttcagacctccca

SEQ ID NO: 28410 - DNA, 201 bp, Homo sapiens
gtttcagtgcctgacacagttgtattcctaagacatagttgggaccagacctcaagaaaatagccaacaaatactggctgaatgaacgaaagaggccataygcagtcagcccccctctctctgggttctacatatgtagatttaactaatgacagattaaaagcattcgaacaaacggagggtggtatctgtactgaaaat

SEQ ID NO: 28411 - DNA, 201 bp, Homo sapiens
ggttggcgtttcagtgcctgacacagttgtattcctaagacatagttgggaccagacctcaagaaaatagccaacaaatactggctgaatgaacgaaagasgccatatgcagtcagcccccctctctctgggttctacatatgtagatttaactaatgacagattaaaagcattcgaacaaacggagggtggtatctgtac

SEQ ID NO: 28412 - DNA, 201 bp, Homo sapiens
acagggacaagaaataaataactttgatgcaaatcctgggaagactctggaacaacatggaggcacctatgttaactctatttcattttggaaaagttgastagacaaaaggtgcagagtagagtatgcagtgatttcagggtgttgggctctgacaagatgatgccgacttagacagtgttagtcaacatcaaatgtctg

SEQ ID NO: 28413 - DNA, 201 bp, Homo sapiens
ccagaggtctgttttcatcacatcgtatcaagcattccaccttcatcatgactcttcactgttgatggtgactctgattcacctggtcaaggtagtgttcrttaggtttctccactgcacacttagtctttccctctactttccacactgctgcctttggaggagtgttgctgtgcccagctcacgcttgtggagtgggga

SEQ ID NO: 28414 - DNA, 201 bp, Homo sapiens
tggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaatac

SEQ ID NO: 28415 - DNA, 201 bp, Homo sapiens
ttaacatgctgttagtgcatgcaaaaaaaagcccagtaattgtagggctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcc

SEQ ID NO: 28416 - DNA, 201 bp, Homo sapiens
gaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaagggctgtcaccaccagaaatttaacatgctgttagtgcatgcaaaa

SEQ ID NO: 28417 - DNA, 201 bp, Homo sapiens
cttgggaagtggactcagaggccaagtgactttgatttttcactttatcctggagtttctcaaccttggcactattgacattttaggccaggagattcttkgttgggggggatttcctgtgagttacaagacattaagcaacatcactggcctctacccactagatgccagtagcatcttctatttcctcaagtctcaaaa

SEQ ID NO: 28418 - DNA, 201 bp, Homo sapiens
tacttttgttctcaccttgggaagtggactcagaggccaagtgactttgatttttcactttatcctggagtttctcaaccttggcactattgacattttargccaggagattctttgttgggggggatttcctgtgagttacaagacattaagcaacatcactggcctctacccactagatgccagtagcatcttctattt

SEQ ID NO: 28419 - DNA, 201 bp, Homo sapiens
ggctggagtagtgtgcagagcctggcggtgattgttctcattagaaagtatagtgtaatactcaataaattacttttgttctcaccttgggaagtggactmagaggccaagtgactttgatttttcactttatcctggagtttctcaaccttggcactattgacattttaggccaggagattctttgttgggggggatttc

SEQ ID NO: 28420 - DNA, 201 bp, Homo sapiens
caggttttgtttttttgtgtgtgtgttattttgttttttgtttttttgtttttcgggggctggagtagtgtgcagagcctggcggtgattgttctcattaraaagtatagtgtaatactcaataaattacttttgttctcaccttgggaagtggactcagaggccaagtgactttgatttttcactttatcctggagtttc

SEQ ID NO: 28421 - DNA, 201 bp, Homo sapiens
agaaacttggacagaggaaaatgaaaatgttctattaattccactagcatgagataatcactcttaatattttgttgcatgttcttttctttcttctgagkgatagcatttttttcaacaaattgggctcgtaatatataggcacatagatatataattaaaaaaacaagaatttctcatgtcattaaacattgcttgaaa

SEQ ID NO: 28422 - DNA, 201 bp, Homo sapiens
tgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaattgtattt

SEQ ID NO: 28423 - DNA, 201 bp, Homo sapiens
ttcctccccttttatcaagagccgtaagtccttggaaaatgcaaagagggggaaaaagaagaaaaacagcaacgagtttattggagagttaacacttaaakactccagtacattgagtgtgacatgcctgtgtaggagactgtctgtcccccaaataattgacaatttctctccatctaacaagaaaatatatggcacttt

SEQ ID NO: 28424 - DNA, 201 bp, Homo sapiens
tcgcagacacggaaaaaaggattattcctccccttttatcaagagccgtaagtccttggaaaatgcaaagagggggaaaaagaagaaaaacagcaacgagkttattggagagttaacacttaaatactccagtacattgagtgtgacatgcctgtgtaggagactgtctgtcccccaaataattgacaatttctctccatc

SEQ ID NO: 28425 - DNA, 201 bp, Homo sapiens
cgcagattgccagtgactccgggaatgcctaggtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggag

SEQ ID NO: 28426 - DNA, 201 bp, Homo sapiens
ggattaagttagggagacagtaatggtattgttagcaggctatttcaatgattttctctgcggaagagtagggaaaggtgacattccaactgggaatattmgactctgcagatccctactcggagtttttcagccctgttttaagtgccgagctgggttttgcctcatgatccaattgttttattagcgaaatcatcatct

SEQ ID NO: 28427 - DNA, 201 bp, Homo sapiens
tacagaccccaaagcttgctgtcccctgggcaggtgcatgagggggtcccaggcaatcaggctcttctcaaacctgaattatacccggcctcagggtatargggtcaggcagctgtttgacaggattcttgcaaatgtttttggtttctctgtctactcattacgtacactctgccagaggttgaaaactcaatgttgaga

SEQ ID NO: 28428 - DNA, 201 bp, Homo sapiens
taaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgacagacccaagttca

SEQ ID NO: 28429 - DNA, 201 bp, Homo sapiens
ttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttcc

SEQ ID NO: 28430 - DNA, 201 bp, Homo sapiens
gtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtttatgtgtgctgcgtgagtgatgtg

SEQ ID NO: 28431 - DNA, 201 bp, Homo sapiens
acacatgtgcagccactgtatgacgtctggattttccttgacttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagagagc

SEQ ID NO: 28432 - DNA, 201 bp, Homo sapiens
tgcaaaggccctggggtggaaacacactcgatgtgttcaagggagagtaagtggtgaatgggtttggagccaacagggataatagacaacgctatcaagargggggccaaccacacatgtgcagccactgtatgacgtctggattttccttgacttatggtgatcactattgggaggtggtaagcaaacaggtgacataat

SEQ ID NO: 28433 - DNA, 201 bp, Homo sapiens
aaatctcaagcacaggtgcagcaagtgcaaaggccctggggtggaaacacactcgatgtgttcaagggagagtaagtggtgaatgggtttggagccaacarggataatagacaacgctatcaagaggggggccaaccacacatgtgcagccactgtatgacgtctggattttccttgacttatggtgatcactattgggag

SEQ ID NO: 28434 - DNA, 201 bp, Homo sapiens
agtagtagtgaatgccctgactttggggtttgcagtaagctaggattaagtgcttcacagtgaggcacagtggggagctactctgaggatgaattgcctartaaataagtgaggtttgtataaccgaggccagatcttagaacctcctgctatctgtacatagaagaatgttttagtcagaggcaaggcaaggtcaccagg

SEQ ID NO: 28435 - DNA, 201 bp, Homo sapiens
gtacaatggctgacgcccgtaatcccagcgctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatt

SEQ ID NO: 28436 - DNA, 201 bp, Homo sapiens
ttgctgagaggtggggagggggtgggggctctgtgcatggaatggggggaaaagcttcagggaagggcagtgcaaattgtttctggactgatgccatcttytaataatagtagttaatagactgggtacaatggctgacgcccgtaatcccagcgctttgagaggccgaggccggtgtatcgcctgagtccaggagttaga

SEQ ID NO: 28437 - DNA, 201 bp, Homo sapiens
gttgctgagaggtggggagggggtgggggctctgtgcatggaatggggggaaaagcttcagggaagggcagtgcaaattgtttctggactgatgccatctyttaataatagtagttaatagactgggtacaatggctgacgcccgtaatcccagcgctttgagaggccgaggccggtgtatcgcctgagtccaggagttag

SEQ ID NO: 28438 - DNA, 201 bp, Homo sapiens
aggtgtttcttatttttatcattttccgtaaaggtaggattgtgttgacagccctgtaataaatgtctcttggaagagatgtgttgctgagaggtggggarggggtgggggctctgtgcatggaatggggggaaaagcttcagggaagggcagtgcaaattgtttctggactgatgccatcttttaataatagtagttaat

SEQ ID NO: 28439 - DNA, 201 bp, Homo sapiens
tcttcttgtaaggtgtttcttatttttatcattttccgtaaaggtaggattgtgttgacagccctgtaataaatgtctcttggaagagatgtgttgctgaraggtggggagggggtgggggctctgtgcatggaatggggggaaaagcttcagggaagggcagtgcaaattgtttctggactgatgccatcttttaataat

SEQ ID NO: 28440 - DNA, 201 bp, Homo sapiens
tttatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatga

SEQ ID NO: 28441 - DNA, 201 bp, Homo sapiens
gctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacga

SEQ ID NO: 28442 - DNA, 201 bp, Homo sapiens
agcctctgacttgcaaggtgtgcttcagaaatttgcagcttctatttaggtaggaagagtttgccagcccgaaaactccagtaagcaaacagctttatagyaccccagccatagaaagtgagagctttcgaagaatctgtggttagaactaagaggatttttctttctcctttttctgctgttattatctcaaggagagag

SEQ ID NO: 28443 - DNA, 201 bp, Homo sapiens
acagttgatctcactgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttca

SEQ ID NO: 28444 - DNA, 201 bp, Homo sapiens
gccttgctgaggaaattaaattcctgttcgagtgctatttctttatggcactgaggagcaagcatttctaacaatcatattgcttaagaagtggatggcargaagataattactaatatgtctgcaattgatctgaaattgacacagttgatctcactgattcatggggaccctgggagtatgtttgtgtatttgggggtt

SEQ ID NO: 28445 - DNA, 201 bp, Homo sapiens
aagggaggctgggaaatatagtttgctgtgtgctgggtgggtgggagggagcgtccacattagtgaacagccaggcagtcgctgcctcaaatttctttagkgttatcctttcattccagcaattgaatttgatttgcactgtttcacttctctacaagggtgtaaaaagtagaggttcctcttgaaagaatttcctcccca

SEQ ID NO: 28446 - DNA, 201 bp, Homo sapiens
tggctgcctgcaagggaggctgggaaatatagtttgctgtgtgctgggtgggtgggagggagcgtccacattagtgaacagccaggcagtcgctgcctcamatttctttagggttatcctttcattccagcaattgaatttgatttgcactgtttcacttctctacaagggtgtaaaaagtagaggttcctcttgaaagaa

SEQ ID NO: 28447 - DNA, 201 bp, Homo sapiens
ttatgtcattggctacaactcagtcacatgaccatggctgcctgcaagggaggctgggaaatatagtttgctgtgtgctgggtgggtgggagggagcgtcmacattagtgaacagccaggcagtcgctgcctcaaatttctttagggttatcctttcattccagcaattgaatttgatttgcactgtttcacttctctaca

SEQ ID NO: 28448 - DNA, 201 bp, Homo sapiens
tcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaa

SEQ ID NO: 28449 - DNA, 201 bp, Homo sapiens
ataaatatttattgagtagtaagcacatgcaaggcattgagggtggggagggaaaaagacacaaattgtccttaccctcatggattcaccatctatttaamggccacaaatacttgtgtgagaagcaagtcttaatagtctgaagtattttcttagattcccttgagccgcaatgctgaaaagcttatggtggttttgcta

SEQ ID NO: 28450 - DNA, 201 bp, Homo sapiens
agctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgt

SEQ ID NO: 28451 - DNA, 201 bp, Homo sapiens
gttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattct

SEQ ID NO: 28452 - DNA, 201 bp, Homo sapiens
gtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaa

SEQ ID NO: 28453 - DNA, 201 bp, Homo sapiens
acaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatgga

SEQ ID NO: 28454 - DNA, 201 bp, Homo sapiens
tccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgattt

SEQ ID NO: 28455 - DNA, 201 bp, Homo sapiens
cctgccgtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaaatacattttgcaaatgatcttctagtaggatt

SEQ ID NO: 28456 - DNA, 201 bp, Homo sapiens
ctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcag

SEQ ID NO: 28457 - DNA, 201 bp, Homo sapiens
tacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctc

SEQ ID NO: 28458 - DNA, 201 bp, Homo sapiens
ctcccattttacaccctgtttattgatactaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgaattcgg

SEQ ID NO: 28459 - DNA, 201 bp, Homo sapiens
ttttaagctaccacacagatgcaggaaactaatataccctttaatgattttctccatggcctttctgataatcctttcatccttcatctcccctgtcgccsttttctttgctttgctttgcttgcttttttttttttttttttttgagacggagttttgctcttgtcgcctaggctggagtgcaacggcacaatcttggtt

SEQ ID NO: 28460 - DNA, 201 bp, Homo sapiens
attgttttaagctaccacacagatgcaggaaactaatataccctttaatgattttctccatggcctttctgataatcctttcatccttcatctcccctgtygccgttttctttgctttgctttgcttgcttttttttttttttttttttgagacggagttttgctcttgtcgcctaggctggagtgcaacggcacaatctt

SEQ ID NO: 28461 - DNA, 201 bp, Homo sapiens
tggccaggagactaggcattcatagtggggcgtcctttaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggta

SEQ ID NO: 28462 - DNA, 201 bp, Homo sapiens
cccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatg

SEQ ID NO: 28463 - DNA, 201 bp, Homo sapiens
ttagcgagatattgtctctactctcaagaaactcgctttctttgggaatcatcacctgtttttgtgtcacggaccccttgggcatttggtgccctttgcasaataatggttttgaatacataaaacgcacgggatcacagaggaaaccaatcatattaaaatacagttgtcaaaatattaactcatgggatctagtaacaa

SEQ ID NO: 28464 - DNA, 201 bp, Homo sapiens
ggtgctagggtaaggcacgcaggatgcaagattagcgagatattgtctctactctcaagaaactcgctttctttgggaatcatcacctgtttttgtgtcayggaccccttgggcatttggtgccctttgcagaataatggttttgaatacataaaacgcacgggatcacagaggaaaccaatcatattaaaatacagttgt

SEQ ID NO: 28465 - DNA, 201 bp, Homo sapiens
gcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcacggaccccttgggcatttggtgccctttgca

SEQ ID NO: 28466 - DNA, 201 bp, Homo sapiens
cagttgtaacagtggtatgtgtatatctcaacatatctaaacatagaaatagtacagtaaaaatatgatattataatctttgggaccgccatcatatatgyagtctgtcattgactgaaagttgtcatgtagcccatgactgtcgtctcttttaggggaaaaaacaaaagcagaaagcaagcaagctggtatcctgcgtat

SEQ ID NO: 28467 - DNA, 201 bp, Homo sapiens
ctgcgtactgtaggcagttgtaacagtggtatgtgtatatctcaacatatctaaacatagaaatagtacagtaaaaatatgatattataatctttgggacmgccatcatatatgtagtctgtcattgactgaaagttgtcatgtagcccatgactgtcgtctcttttaggggaaaaaacaaaagcagaaagcaagcaagct

SEQ ID NO: 28468 - DNA, 201 bp, Homo sapiens
ttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctgattaattg

SEQ ID NO: 28469 - DNA, 201 bp, Homo sapiens
gggctggatttgtcctgtggactgtagtttgctgacatccaggctagatccttaatatacaatgaagtagtaaaacacatgtaaaagtaaaaagcaggcgwaatagaataaaatacacatttgcacaccacagtatccaaaaaggttatgtactggggctaaagatttggcttggagtttcctggtagtcaaggcaaaaaa

SEQ ID NO: 28470 - DNA, 201 bp, Homo sapiens
atttccacccccattatttgcataacaaattacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcgaaatagaataaaatacacatttgcaca

SEQ ID NO: 28471 - DNA, 201 bp, Homo sapiens
ttttgctctcctccttttgtcagttggcatgcgatatgcttctcaggcagtaatttagagactgtcaattcctgagagccgctggggaactgagcaatcgyctgcatttcgtcgctttagcccgagctgggtctttgagctggcagagaccaagatctttttctgggaagggatggtcctatttaaggaaggccctggatt

SEQ ID NO: 28472 - DNA, 201 bp, Homo sapiens
atgtgtctgaccccaggagaactgccccgatccctatcttgtctctgctcagttctggtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacaca

SEQ ID NO: 28473 - DNA, 201 bp, Homo sapiens
gattacagacaagagccactgcgcagacggacatatgaatttttaatttgatatcattgtgatcaatttgaagatccacatatggctgagggctactctawtgagtggtgcagctccaaggcagagagatggctgtgattaaccaatgaatgagggaacaaatatccaggcagaatgaatagtctatggaaagggctggaa

SEQ ID NO: 28474 - DNA, 201 bp, Homo sapiens
aagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcct

SEQ ID NO: 28475 - DNA, 201 bp, Homo sapiens
gcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacacttttttggaaccattgaaaagtt

SEQ ID NO: 28476 - DNA, 201 bp, Homo sapiens
gagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgt

SEQ ID NO: 28477 - DNA, 201 bp, Homo sapiens
tcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccat

SEQ ID NO: 28478 - DNA, 201 bp, Homo sapiens
gggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgttgtcaaagtactgttaaggtatgaaaaccctgctagtattag

SEQ ID NO: 28479 - DNA, 201 bp, Homo sapiens
cccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaat

SEQ ID NO: 28480 - DNA, 201 bp, Homo sapiens
tggttttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagtt

SEQ ID NO: 28481 - DNA, 201 bp, Homo sapiens
ttcattgttgtccttttttattaaaacaggttttgtttttttgtgtgtgtgttattttgttttttgtttttttgtttttcgggggctggagtagtgtgcaragcctggcggtgattgttctcattagaaagtatagtgtaatactcaataaattacttttgttctcaccttgggaagtggactcagaggccaagtgacttt

SEQ ID NO: 28482 - DNA, 201 bp, Homo sapiens
gcttggaaggtggcgcaaataactgcttgaggctccctctcttgggccaagcttgactctggattttcattgttgtccttttttattaaaacaggttttgkttttttgtgtgtgtgttattttgttttttgtttttttgtttttcgggggctggagtagtgtgcagagcctggcggtgattgttctcattagaaagtatag

SEQ ID NO: 28483 - DNA, 201 bp, Homo sapiens
tggacaagaggtcacattgccttttctagcttggaaggtggcgcaaataactgcttgaggctccctctcttgggccaagcttgactctggattttcattgktgtccttttttattaaaacaggttttgtttttttgtgtgtgtgttattttgttttttgtttttttgtttttcgggggctggagtagtgtgcagagcctgg

SEQ ID NO: 28484 - DNA, 201 bp, Homo sapiens
ttccttttgagcccagctctccctttgtgacccagcaacttccttccccgatgatggccaagccttgaggatgtgaaactgcccagtgccccaatctggartccaccatcctgggtctagctggggacatccttgaatcagcctctgggaatcactgaaccaacatgagtcacttgctactgtgagatctcaaaacacatg

SEQ ID NO: 28485 - DNA, 201 bp, Homo sapiens
aggccaagaaaggggtgggagaaacgagcaaggtgttgatagaaccccttagtgtcctcctcataccacagacactctcttcccccacttacttggccaawttttttttttttttttttttttttttggtggagtctcgttctgtctcccaggctggagtgcaatggtgcgatctcagctccctgcaacctctgcctccca

SEQ ID NO: 28486 - DNA, 201 bp, Homo sapiens
tgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggacacattcagaccacaa

SEQ ID NO: 28487 - DNA, 201 bp, Homo sapiens
cctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaa

SEQ ID NO: 28488 - DNA, 201 bp, Homo sapiens
tgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcct

SEQ ID NO: 28489 - DNA, 201 bp, Homo sapiens
ggtgcctaaagtttgagaacttctgatcaaaaatgccagataagaaaaaaaaacctttcgagacatcatttgaatcaattatcaaatgtttccaaagtgcrcttgctttgcaaaccactgtactactcatctctgcctccatcggagcgagttcaggagagttgtgtttacttttctaaaggagccttttccttcccattt

SEQ ID NO: 28490 - DNA, 201 bp, Homo sapiens
gatttagaatcagaaagtgtgagttcaaattgccttcggctcttcacctgggtgggcgatttgaatagagctcacagccctgaaaaccctggttttcagaytctttattggtaaatgaagtcagcttagtgatatgagaattatgaaacataaatccctttgtaaaaatataaaataatcttacaatcatcatcgtcatcc

SEQ ID NO: 28491 - DNA, 201 bp, Homo sapiens
catgtaaatgaattgtattttatgtaaccattccctagtgttggatagctaggccatttataatttggacactattttaaaaaataactcaggcttatttwactatttatttttgccttacactttttgtaaaagtaatcagagcagtaataatagatgactccccaaaatccttttgcctctaatgattagtctaagccc

SEQ ID NO: 28492 - DNA, 201 bp, Homo sapiens
tagagaaaaggtggcttggctgtttggtttatgtcctaaaaccttatcgtaatgtgattctccttaacagagggattcgtaagcttaggactgatagagawttggcttttctgctgttggattgatagctccttgactgctgaagccattgcccatctgttcaactgttgtattcacgaggaggttagacccctgacccaa

SEQ ID NO: 28493 - DNA, 201 bp, Homo sapiens
ctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagc

SEQ ID NO: 28494 - DNA, 201 bp, Homo sapiens
gggctatcaaaaatatagtttcgtttggaaaacaaaggggtgaggtgggtccaaagtacaggaagctataccatgcaaatgaaaatattttttccaaagcyatctgctaatccctgtgatttaaaaatgtgcgtgtttttagtttctgtctaatttcaaccttttcttgctttagtgattaattaccaggtttctctatta

SEQ ID NO: 28495 - DNA, 201 bp, Homo sapiens
ttaaagcgatagtcctattttctaagtaaaagtccaggcatgtgacttaaaaaagaaaaaaaaaaatgttttctggtcaagtcacatgcctctgaggtttktttttttctttctttcttttctttttttttctttttcccagactcctcatacccctcctaggagacagtgattccctggcttcaccaggcaggctcttgg

SEQ ID NO: 28496 - DNA, 201 bp, Homo sapiens
actttacattttgagtttcgatttttttttttcacctgggctagtaatacgtggtaggatactctctcacaatgctaggccacagcagcgagctgcagctyccagtgatcacaagggcaaagaatcgatattctaccaggcacggtgttgcctgataaccttgcccagctgtaggctaatgtaagtgttcttttttatatt

SEQ ID NO: 28497 - DNA, 201 bp, Homo sapiens
gcctgggtgatagagcgagaccctgtctctgaagatacaagaaggccacatgtggtggttcacccctgtaatcccagcagtctgtgagactgaggcagaargattgcttgagaagtttgagattggcctgggaaatatagcaagatcccaaccctattaaaaaattaaaaatgaaaataaaattttaaagaaaggtatttc

SEQ ID NO: 28498 - DNA, 201 bp, Homo sapiens
aaacaaacaaacaaaacaaaacaaaaaaggtttaagaaatgttctagtaccttgaaaccaaaataggtatcagatacttggctgttttgttttttcttctwagccattttgacctgtgagattttatgtgatgaaaacataagaatgtggtattacaccctgtgatttgaattttccatactccattccattctatatgtc

SEQ ID NO: 28499 - DNA, 201 bp, Homo sapiens
tcttgggctggctcattacaggccactctgtctgaggaacactcaggtttgcaaaccgtttcttaaaattacaggatacctagggacctgttggggtgggwgggaagaaccctatgggcagaaatgtgactttctgtagcaaagatgtactgtttcccactgagaagaatcaaaaatagaaaagtgcttccttgtctctct

SEQ ID NO: 28500 - DNA, 201 bp, Homo sapiens
gaacctttctcttataaggatactaatcccatcgtaccccgtcccccatgatctcatttgaaattagtcacctcccaaagccccacctccaagtactgtcmcactggggcatagggcttcagcatatgaatttgggggagctggggagaggaacacatacatttagtccataacaactatctcacttacctctctactaag

SEQ ID NO: 28501 - DNA, 201 bp, Homo sapiens
taacataataccatagactgggcaggttaaacagcagacctctattcctcacagtctagaggctgggaagtccaaggtgaagccatgggcacattctgtgsctgcctgaggctctctttctggttcccagatggatgcctttgtgtgtcctctcatggcagagagaggaaggggtctggaacctttctcttataaggatac

SEQ ID NO: 28502 - DNA, 201 bp, Homo sapiens
ttatccatgccatctgaaatcctccttcctttttaacaaggcaagtagaaaacgaaaacaacatcaaaggatacactacacaattgttggagccctaggamccgagagaagagtacaagcaggttcttgaactgttctctccccagcaactataactggaaggaacctcagtttgtccattcattcattcatcagagcagc

SEQ ID NO: 28503 - DNA, 201 bp, Homo sapiens
gtttttatatgcagtttgtatttatccatgccatctgaaatcctccttcctttttaacaaggcaagtagaaaacgaaaacaacatcaaaggatacactacmcaattgttggagccctaggaaccgagagaagagtacaagcaggttcttgaactgttctctccccagcaactataactggaaggaacctcagtttgtccat

SEQ ID NO: 28504 - DNA, 201 bp, Homo sapiens
cttacaatccgttgcagaaagcctagctccccagcttctcctgaatctacgtttttctattttgtctgaactagccaaggtctctggagtttgctgttatmttgcttcagagaaattagtgacattgaaaggctgttgtcttttttagtgtacttttggttgttaggagaaatttacaaggccatttttttctcccgtctc

SEQ ID NO: 28505 - DNA, 201 bp, Homo sapiens
gctcactgcaaactacccccgcccccgggttcaagcaattgtcgcacctcagcctcccaagtaactgggattacaggtgcccaccaccaagcccggctaakttttctattttcaatagagatgaggttttgccatattggtcaggctggtcttgaactcttgacctcaggtgattcacccacctcagcctcccaaagtgca

SEQ ID NO: 28506 - DNA, 201 bp, Homo sapiens
aaaattcaaaaaattgcaacctgaggcataaatgggttttaagctccatacagtaaaacctagcatatgaaaacagttctggctgatgggttggtagaagkgatagatatagatacatatatacacatatatgcacagtaatagatataggtaaagaccttgatatatgtacatatattgtatgatacatatccatgcata

SEQ ID NO: 28507 - DNA, 201 bp, Homo sapiens
ctcaggatgaggatgttcaatttgtactgctggtggagctgcctttccattaagtgagtctttctccaagggaacagaagtcttaggttgttgatctggckgtcagaacctaggacaggcaaggcagtgggctgttgtagaggagatgaagctgatcagagcacacccacaccagtgacaaccggtcaggacctgggaagg

SEQ ID NO: 28508 - DNA, 201 bp, Homo sapiens
ccttactgttgaagacttgtggaaaagggacatggcccagggaaccagagtggtttgggaaagcactttgtcaagaggcttggggaccccagggtggaagytgccatgcgcatgaggctgtgttagcagaggcagtggcagaagaagacattgcaaacctgcaaaagcaacctctgaggatgggtagacatatacttcatt

SEQ ID NO: 28509 - DNA, 201 bp, Homo sapiens
ggtgatcctgctgcttggcagcatcttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccataca

SEQ ID NO: 28510 - DNA, 201 bp, Homo sapiens
taatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataact

SEQ ID NO: 28511 - DNA, 201 bp, Homo sapiens
atttctttatcgtaagcacacttctctacattacctttataatccaacaactctgctattagtaaattatagaaacaacttttgtaacactatcttgtttscagagtatatgaaaaatttgaagttaaaattcagctccacgaatactgcagtggtgagaaaatggcgacaaagattagtcttctgtgagaagtctgctaa

SEQ ID NO: 28512 - DNA, 201 bp, Homo sapiens
aggcctgagcaaaagacacagaaaggatttctttatcgtaagcacacttctctacattacctttataatccaacaactctgctattagtaaattatagaamcaacttttgtaacactatcttgtttgcagagtatatgaaaaatttgaagttaaaattcagctccacgaatactgcagtggtgagaaaatggcgacaaaga

SEQ ID NO: 28513 - DNA, 201 bp, Homo sapiens
cacgaacaaattgccaaatgcaaggcctgagcaaaagacacagaaaggatttctttatcgtaagcacacttctctacattacctttataatccaacaactytgctattagtaaattatagaaacaacttttgtaacactatcttgtttgcagagtatatgaaaaatttgaagttaaaattcagctccacgaatactgcagt

SEQ ID NO: 28514 - DNA, 201 bp, Homo sapiens
tcccatcacgaacaaattgccaaatgcaaggcctgagcaaaagacacagaaaggatttctttatcgtaagcacacttctctacattacctttataatccamcaactctgctattagtaaattatagaaacaacttttgtaacactatcttgtttgcagagtatatgaaaaatttgaagttaaaattcagctccacgaatac

SEQ ID NO: 28515 - DNA, 201 bp, Homo sapiens
aaatgtccagctttctttcttttattcaaaatttatacttcataattgaagttcacctcccaaaagacatagcttggtttagcatagagctatgatgtgtkttctctttgttccttttgcacactttccttgtctggaggcgttgggcttggatccttcattcttcatgaggctgatgtttttccatttcggtttccttaa

SEQ ID NO: 28516 - DNA, 201 bp, Homo sapiens
aaaatgtccagctttctttcttttattcaaaatttatacttcataattgaagttcacctcccaaaagacatagcttggtttagcatagagctatgatgtgktttctctttgttccttttgcacactttccttgtctggaggcgttgggcttggatccttcattcttcatgaggctgatgtttttccatttcggtttcctta

SEQ ID NO: 28517 - DNA, 201 bp, Homo sapiens
aactcctgagggatgctcaggaaaccaaaaaggatgtctgcatggaggacaagaaggcacaaatcgtctgatttcaccccatcctaagatcttgtgacttmagctttgttttggactggggcattggatctcccacatgccctctcttaagtcgtgcatttgacgcatatttaataagcacctactgtgtgccattagaga

SEQ ID NO: 28518 - DNA, 201 bp, Homo sapiens
tagttctgtccctgaaggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaa

SEQ ID NO: 28519 - DNA, 201 bp, Homo sapiens
ataagccctgaagtctggacactgagagaattctaggcttgacttctctgtacagccatcttgggagtgctcaaccctttgaatcggatgtctagaatggmctcagatgtcactgtgcaggtgactcacgcctagaatcctctgcctatcgtgacagggagaagcctgtgtgaccctgtggccatctcagtctctgcaggg

SEQ ID NO: 28520 - DNA, 201 bp, Homo sapiens
taagccctgaagtctggacactgagagaattctaggcttgacttctctgtacagccatcttgggagtgctcaaccctttgaatcggatgtctagaatggaytcagatgtcactgtgcaggtgactcacgcctagaatcctctgcctatcgtgacagggagaagcctgtgtgaccctgtggccatctcagtctctgcagggc

SEQ ID NO: 28521 - DNA, 201 bp, Homo sapiens
caaatgcagcatcgcttgaagctgtgataaaatatcacacctttggaaatcaaggctcttcttgtttatttatttaactcacattaattagccttaatttwaaaaaaatgagaagagccagcatcatgatgcaagcattgactttgctcacaaaaacatcttgtggtcaacagtggggcttagggggcaggttttgtggct

SEQ ID NO: 28522 - DNA, 201 bp, Homo sapiens
atgtgtggccaatctcacaagatactaattctttttttcaaatgcagcatcgcttgaagctgtgataaaatatcacacctttggaaatcaaggctcttctkgtttatttatttaactcacattaattagccttaatttaaaaaaaatgagaagagccagcatcatgatgcaagcattgactttgctcacaaaaacatcttg

SEQ ID NO: 28523 - DNA, 201 bp, Homo sapiens
ttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaa

SEQ ID NO: 28524 - DNA, 201 bp, Homo sapiens
tgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcat

SEQ ID NO: 28525 - DNA, 201 bp, Homo sapiens
gcaaagtcaagttggagatggctctcgatatgcatgagtgtgttagactgcttttcttctattttttaaaaatgcacccaaatgtaaaagacacttttacstttttgatttgatgttgaaggtcatttgaaaaatactctgtctttattctttgaaatggatttactctcaagaaagttgcatgtcactttacttggaaga

SEQ ID NO: 28526 - DNA, 201 bp, Homo sapiens
taatttttgtatttttagttagacaccaggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgct

SEQ ID NO: 28527 - DNA, 201 bp, Homo sapiens
gcaacctctgtcgattctccttcctcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaagtgctgggatgacaggcgtgagctgcct

SEQ ID NO: 28528 - DNA, 201 bp, Homo sapiens
attagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcctcggcctccgtagtagtcaggactacaggcatgcac

SEQ ID NO: 28529 - DNA, 201 bp, Homo sapiens
gtcattgattgaaagagtcatggcatagatgctgaagttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaa

SEQ ID NO: 28530 - DNA, 201 bp, Homo sapiens
atagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttat

SEQ ID NO: 28531 - DNA, 201 bp, Homo sapiens
ggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcctctga

SEQ ID NO: 28532 - DNA, 201 bp, Homo sapiens
tatagaacatttctaccatagtagaatgctcttttggatacatctgctttaaagcattagtccccaaagtgtgaaggatgaaccacttgggttccgagagraaacattataacttctgtttatccattaaactctttcatttattattaaacatctcaacacatttattgggtggcaggtactgttttaagtgttttgcat

SEQ ID NO: 28533 - DNA, 201 bp, Homo sapiens
attgggtagcaccgatatagaacatttctaccatagtagaatgctcttttggatacatctgctttaaagcattagtccccaaagtgtgaaggatgaaccamttgggttccgagaggaaacattataacttctgtttatccattaaactctttcatttattattaaacatctcaacacatttattgggtggcaggtactgtt

SEQ ID NO: 28534 - DNA, 201 bp, Homo sapiens
tatggagtgtcagaaatagtgaagcttctggagcttcactgtccaatatggtagccacgtgtgactattaaaatgtaaattaattaaaattaaaagttcarttgctctgaaatagcagccacatttcaaatcttcagtagccagatgtggttattggctaccatattgggtagcaccgatatagaacatttctaccatagt

SEQ ID NO: 28535 - DNA, 201 bp, Homo sapiens
atcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttaga

SEQ ID NO: 28536 - DNA, 201 bp, Homo sapiens
ccatgcccaccttgctgttgcaccccccaccccaaggaaagccttcccacctttggaagctgcattaattcttccaggccacaagggggccgttgagttastggttcactgcactggctggcaggaaagagttttaatgcaggctccaaaggtgcttaatttcctgtggtccttatgaatatgcatacagtatgtgctcag

SEQ ID NO: 28537 - DNA, 201 bp, Homo sapiens
taaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatacatgataaatacaagtagtagcatttttagtaaaggctgttacaaaatac

SEQ ID NO: 28538 - DNA, 201 bp, Homo sapiens
cctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccag

SEQ ID NO: 28539 - DNA, 201 bp, Homo sapiens
taaagtttagacctattttaataaggctgacttgggttgaagataactagagccatgactttcatcttgatggacaatgagtactcactctacttttttaktttatatttttattttagttcatttcatttaagacagcgtctgttacccaggctggagtgcagtgacatgatctcggctcactgcaacctacaccttctg

SEQ ID NO: 28540 - DNA, 201 bp, Homo sapiens
tgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcgcatactcattttttgc

SEQ ID NO: 28541 - DNA, 201 bp, Homo sapiens
cctatctgtgatgacctgtaaatggaatttaagggaggaatcacacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcat

SEQ ID NO: 28542 - DNA, 201 bp, Homo sapiens
agcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatcataacatcaaaggtgtgtgtaccattctatgaccattgaatct

SEQ ID NO: 28543 - DNA, 201 bp, Homo sapiens
aaacaaacagatctcaggagaactctttcacaagacagcactagggggatggtgattagaaagcacctcatgatcccgtctacttcctgcagagaacagaytagccccctatgcagcacacacctttgtgaggtccctcctccaacacagggattacaattcaacctgagacgtgggtggggacacagagccaaaccacac

SEQ ID NO: 28544 - DNA, 201 bp, Homo sapiens
ggaccaagttttattccctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtct

SEQ ID NO: 28545 - DNA, 201 bp, Homo sapiens
gctcctacaccatgagtgcttttgtatggtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgtgtatttaagctccag

SEQ ID NO: 28546 - DNA, 201 bp, Homo sapiens
ttttggaggacttgaaaggttcctgctacctttggctggggatggagggaacatggaagatgggtctttgtttagaggaagctctttatcctggtacgctrgaagttggcatagtcttagcagttagtccagatgtgaatttcaggattattctgtgagtcttccaagtcctgtctcagcagtgaaataggctcagtgtag

SEQ ID NO: 28547 - DNA, 201 bp, Homo sapiens
tggttcagggtgttgaggcttcgtgctgttaatattggaaggtgggtcatttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctg

SEQ ID NO: 28548 - DNA, 201 bp, Homo sapiens
agcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgc

SEQ ID NO: 28549 - DNA, 201 bp, Homo sapiens
ttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaag

SEQ ID NO: 28550 - DNA, 201 bp, Homo sapiens
actaggggaaacaaaccctgttttgtagtatttgctgattactgtggtgtaaatactcacaccttggctgatttcaagttgcagcttggaacttggagttrgaaagagatgtgtagtcccataccattttatgtatgtaaagtatttgcactatgccgactaatagacataaataacctcatgagcatagataatagtcac

SEQ ID NO: 28551 - DNA, 201 bp, Homo sapiens
ggcttcatatattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctagg

SEQ ID NO: 28552 - DNA, 201 bp, Homo sapiens
tgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttcttcctcccgtttggttgg

SEQ ID NO: 28553 - DNA, 201 bp, Homo sapiens
ataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggt

SEQ ID NO: 28554 - DNA, 201 bp, Homo sapiens
gttacatcaaggctgggaggaggtctttccactggttttccgggctgtttgtgtactacacagcctgtgtacctggcaaggcacgctctgctctgccctgmcttctgatgagctgactaacaccttatagatgaggttcccttagaaccaaagatgccccatgaaactccctaggatgaatgttggaagtccttccaactg

SEQ ID NO: 28555 - DNA, 201 bp, Homo sapiens
aatttgtaggagctgctcttaatgattattactgcataggctggaatagaagcaaaatttgcagtaatacttttgtacctttctctttaggccttggcatrtattaaagtactatacatttgtcttaaaaattgaaattgtagattattttcatctaagacccttttgttcacagatttttttttccaagtatacctattc

SEQ ID NO: 28556 - DNA, 201 bp, Homo sapiens
ttgtggtcaacagtggggcttagggggcaggttttgtggctgtgacagaacacgtggcccctagtgtgtctgttgaaagatgggcccctttcaggaaaatkgcttaccttactttttagacataatttttgttttctgttaaagggtcagttatagataagtatgctcccttgcaatgaaatgaacccactttatcaattt

SEQ ID NO: 28557 - DNA, 201 bp, Homo sapiens
taccaccacgcctggctaattttttgtatttttagtagagacgggatttcaccatgttggccatattggtcttgaactcctgacctcaagtgatcctcccrcctcagctgcccagggtgctgggatcacaggcgtgagccaccgtgcgcgacctcagggtcccttctaacctgtgctgttgtcataaaccctggaggagaa

SEQ ID NO: 28558 - DNA, 201 bp, Homo sapiens
tgcaggcttaaggctggaagaaaccccaagcatttggccaggaagaggcaactagttccagctggcccacatactacactttaaaaattacccagatgatstgattctgtagagagagagtgggtggagaggactccagggccatggaggaagattcggcctttctctccctaatcatgagcaatgtgatttggagagaga

SEQ ID NO: 28559 - DNA, 201 bp, Homo sapiens
cttcaaagatacaaagctagaaactacaaaactaggcatggttaataaataactgaaataccaggtgtatagaaatgcatctgtggaaaaatgaaatcatrtattctctaggatatattaggaaatggctctttggcaagtctagagggtaaagtatccctgaagggggaaaaggtttaaaaacagtaaactaaagaagat

SEQ ID NO: 28560 - DNA, 201 bp, Homo sapiens
tagttcaaataatacatatgctgaaattcctatatcccccccatactccagatcttcagtgtggaatttaaatataattccttattgtaaaaaaaaaaaawttttttttgatcaaggtgattttgataaactaaatgcatctttaattttactcacagcaaagcgattctttattttctctctaaaagcataattgatgtg

SEQ ID NO: 28561 - DNA, 201 bp, Homo sapiens
ccaacctttttgctggctctctttcaaactgtactgctcactttgggctgtacgttagaaccacctgagaagttctttttctttcttttttttttttgagrtggagtcttcctctgtcacccaggctggagtgcagtggtgggatcttggctcactgcaacctctgtctcctggcttcatgccattctcctgcctcagcct

SEQ ID NO: 28562 - DNA, 201 bp, Homo sapiens
ggctgcagcagtgtctaggtatctgtgaatgtgtaagaaattgagacagcctgcaaaatagctcacccagcttttctttaaagttccaacctttttgctgsctctctttcaaactgtactgctcactttgggctgtacgttagaaccacctgagaagttctttttctttcttttttttttttgaggtggagtcttcctctg

SEQ ID NO: 28563 - DNA, 201 bp, Homo sapiens
tgtgggcccttctctttcctcgtgatgcacggtgatagtgcgtatctaacacttgaaggtgtccacgctggccctagctcagtgagatggctttgctttgsgggggtgagggggcggaggtggtggaaaggcagcaagctacgatgttcttatgtgtgtggccttgcttctggtggtggggtggcacacatgctctgtagt

SEQ ID NO: 28564 - DNA, 201 bp, Homo sapiens
tccatgacactggtctgcacaatgagtgtttttgtatatgaaccgaaaaacaggtagcaaaagcaaaaatagacaactgggattacaacaatctaaaaaayttctgtacagaaaggaagcaatgaacagagtgaagcagcatcctacagaaagagagagaatatttgcaaaccacacatgtgataagggattaatattcaa

SEQ ID NO: 28565 - DNA, 201 bp, Homo sapiens
acagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaatttctgtacagaaaggaagcaatgaacagagtgaagcagcatcctacagaaagagagagaata

SEQ ID NO: 28566 - DNA, 201 bp, Homo sapiens
cactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggatt

SEQ ID NO: 28567 - DNA, 201 bp, Homo sapiens
gcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgtcgaacttgccctacatactgttttattatatattctgccca

SEQ ID NO: 28568 - DNA, 201 bp, Homo sapiens
gccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactt

SEQ ID NO: 28569 - DNA, 201 bp, Homo sapiens
tgccattgcactccagcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttgtatctcgctctttttttctttcttttttttttttttggagacaga

SEQ ID NO: 28570 - DNA, 201 bp, Homo sapiens
gtgaacagattcttccaggtcttcattgtggcggaagaaagtgagatcagagatcccgaggaagggcttcagtttcaccagtagtggagctagggagtagsggggcagaagccgcaggaagtcagtgcaggacgccggaggccactcctaattgcttcatgtgttgttgccgtgctgatgaccttggaggcgctgctggtc

SEQ ID NO: 28571 - DNA, 201 bp, Homo sapiens
ttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttggctacttgtttaattttttgcagaca

SEQ ID NO: 28572 - DNA, 201 bp, Homo sapiens
tactgctattgttagtttctaaaggcacttgtcatggtgtgactaatattagaagcagacacagccatgatgagcaatactctttttttgtttatttttgwtgttactgctgtaagccactttcttctccctctccgttaaaatgcaacttaattggtaaagtttagttgactagagatttcatttatttatttatttatt

SEQ ID NO: 28573 - DNA, 201 bp, Homo sapiens
aaactgtgtgattctgtctgcagttgagaactgtaagaaaaagatcaagattaacattattattattggtgttacctcatgtctgtacctttttggacacktgggtctgtttcccgagaaatcatttttcctcctccttgaaaatagtgaatttcaagtggttttaattttaactgcattatttgtttgctttatatagtt

SEQ ID NO: 28574 - DNA, 201 bp, Homo sapiens
cggaggttacagtgaaccgagatcgtgtcactgcactccagcctaggcgacagagcgagaccctgtctcagaaacagaaaataaaacaaacaaaaaaatastattccatagctgactattttctgaaatgattttgttacttttctaatgagaaaaaaatagatctcgtgtgtggagggaattgaagatgtaatttcagac

SEQ ID NO: 28575 - DNA, 201 bp, Homo sapiens
ttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatagaaaatagatatacataa

SEQ ID NO: 28576 - DNA, 201 bp, Homo sapiens
agctgccgttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttagcaaaggtgaagtggtcctaatctgcggcc

SEQ ID NO: 28577 - DNA, 201 bp, Homo sapiens
cagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattaatttgctt

SEQ ID NO: 28578 - DNA, 201 bp, Homo sapiens
cttgatgtcggagtgttctctagacctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagt

SEQ ID NO: 28579 - DNA, 201 bp, Homo sapiens
ctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcagagcacaatgatgttgctcattt

SEQ ID NO: 28580 - DNA, 201 bp, Homo sapiens
tatatgtgtatacatacatagaagtatatatataaataccagtactagtgtctgctaataggtggcgccactttttatctgtgtgtgttgggggtggaatkagcatgtagaggttggcaaaggggacaggagactgtgggatgattagtatattcttatttggcctgggagggaaaaaaaatctttcatttccaacaatat

SEQ ID NO: 28581 - DNA, 201 bp, Homo sapiens
ataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaattagcatgtagaggttggcaaaggggacaggagactgtggg

SEQ ID NO: 28582 - DNA, 201 bp, Homo sapiens
cttacatttaaatacaggcctttcccatttcacagtgtttctagctcccctttccaatacatctctctctctctttctctctctctctctctctctctcamacacacacacacacacacacacacacagccaaatcagacaccaacataaactgtagagttaacattctttttccaccctcacactttttttagctccgat

SEQ ID NO: 28583 - DNA, 201 bp, Homo sapiens
gcacatatgtgtgtgtgcaaattgtacttgcagtggctgcctgggaaatgaaatttctgcaccttgccagagcatgttttccctctaaagagaggcagctsataattagtaatgctaatgtcggggtgagatgcaatagataatctaacaccagcaatgatgcccagagcatttatctttgatgctgggaatgcgttcatt

SEQ ID NO: 28584 - DNA, 201 bp, Homo sapiens
ccgattctcttccacgtgtggacagattggcacatatgtgtgtgtgcaaattgtacttgcagtggctgcctgggaaatgaaatttctgcaccttgccagarcatgttttccctctaaagagaggcagctgataattagtaatgctaatgtcggggtgagatgcaatagataatctaacaccagcaatgatgcccagagcat

SEQ ID NO: 28585 - DNA, 201 bp, Homo sapiens
tgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtg

SEQ ID NO: 28586 - DNA, 201 bp, Homo sapiens
agatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgat

SEQ ID NO: 28587 - DNA, 201 bp, Homo sapiens
gtcttttttttttttttttttttcctccttttttgagagagagagtctcactctgtcacccagactggattgcagtggcacaatctcaactgactgcaacstgcacctctcaggttcaagcaattatcaggcctcaacgtcctgagaagctgggactacaggcatgtaccaccacactcagctaatatttgtatttttagt

SEQ ID NO: 28588 - DNA, 201 bp, Homo sapiens
gggaaaatggaggagaatgatgacgaaggaggaggaggaggaaaaggtgacttgcctctagctgatgtggattatttctcttttttaatttccatgtctgygtagcttcatcatagatctcagcttaaggacaatgaaagtcgtttattgagtacttagtatgtgctggttgcagagccaagtcttttttttttttttttt

SEQ ID NO: 28589 - DNA, 201 bp, Homo sapiens
acagacagtgtaatttccctggaaactcaattttgattcagacgtccacagcatctcatttctgcctttaaaaaatttcaagagtggcattttggcatgaytggactcacaggtggagaaggtatgacaaacattctggaaatcttggaaggtgaaatatagggaagatggcccctatggaggttcattgtcccccacctt

SEQ ID NO: 28590 - DNA, 201 bp, Homo sapiens
cgtcctcgccctcagcatacttgctcattgtttgtttccatctctatcatctctgtgagccctttgaggatggatgtgtgtccatcttgttaacagttggmtccccagtaaccagtacagtgccagatacagagtagtaaccctacattctagcgtaggcaaatattctagtatttgccaaaactagaggatgaatgagtg

SEQ ID NO: 28591 - DNA, 201 bp, Homo sapiens
tctttgaaagttgtccttctgcacccattttccccagacctaacctcgatttgtgctccaggtctgagcagaaatgttattccctccagaaagccttcccyggatgttgagggatgaagttgtagccccctcccgaatgcgtcctcagaactcgctggttctcgtcctcgccctcagcatacttgctcattgtttgtttcc

SEQ ID NO: 28592 - DNA, 201 bp, Homo sapiens
tgattattttgctctttgaaagttgtccttctgcacccattttccccagacctaacctcgatttgtgctccaggtctgagcagaaatgttattccctccaraaagccttccctggatgttgagggatgaagttgtagccccctcccgaatgcgtcctcagaactcgctggttctcgtcctcgccctcagcatacttgctca

SEQ ID NO: 28593 - DNA, 201 bp, Homo sapiens
tggcccaccagccatggtttggacaagcttagtctacaggttcttcaagaggggcttgagcatttgaaagacttctagtgggagagatcacaaggtacaastagaaaatcctgggctggcctgagaggcagacctgtgattattttgctctttgaaagttgtccttctgcacccattttccccagacctaacctcgatttg

SEQ ID NO: 28594 - DNA, 201 bp, Homo sapiens
aacttgtgtagggaaactctcccttatgataccgtcagattccttgagacttatttgctattgtgagaacaccttgggaaagacctgcctccatgattcarttacctcccacctggtccctcctgcaacatgtgggaattcaagaagagatttgggtgggtacacagccaaaccatatcaaaaaccatttacaaaactcta

SEQ ID NO: 28595 - DNA, 201 bp, Homo sapiens
ttcagcagtctgcctttccctttctgttataaaatcatgtttttattgaattacattttaatattggtatcactttaaaatgaaaatgagtacttgcaaamtgtatttttgaaggagttgggtggtggtggggggatgccattttggcaacagatgacttcggttcaagtcctctctctgtctcttacttgctttgtggct

SEQ ID NO: 28596 - DNA, 201 bp, Homo sapiens
cttctaagcacttcttaggtgcctctgggctttttaacattctttggcagttgtaatttattaattgatttttaaatttggccggtgaaaatgaactttargtaggggtttgaggaaaatgaaaaggcctatttgtttttcagtggctggttcttcgtgttcagcattaaggattggtagaaatcaggcaacctctatgta

SEQ ID NO: 28597 - DNA, 201 bp, Homo sapiens
aaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaa

SEQ ID NO: 28598 - DNA, 201 bp, Homo sapiens
tttggttctttaacattctcttcttcactaaacccaaattaataattccttactattgtcattaaaagttctcactggatcattccatttatactcagagkaacaaagcaaacccaattatttgagagacactgaaatgaattttgagtctagaacagcatctgcaaactttgcaaaggttcacatgataaatattttctg

SEQ ID NO: 28599 - DNA, 201 bp, Homo sapiens
ctttggttctttaacattctcttcttcactaaacccaaattaataattccttactattgtcattaaaagttctcactggatcattccatttatactcagartaacaaagcaaacccaattatttgagagacactgaaatgaattttgagtctagaacagcatctgcaaactttgcaaaggttcacatgataaatattttct

SEQ ID NO: 28600 - DNA, 201 bp, Homo sapiens
tctttatttcaaaaagagtggctgtgaatctttaaaaatttctttggttctttaacattctcttcttcactaaacccaaattaataattccttactattgkcattaaaagttctcactggatcattccatttatactcagagtaacaaagcaaacccaattatttgagagacactgaaatgaattttgagtctagaacagc

SEQ ID NO: 28601 - DNA, 201 bp, Homo sapiens
cgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagt

SEQ ID NO: 28602 - DNA, 201 bp, Homo sapiens
gctgggaagtccaagatcaagctgctggcagattgagtgtttggcaacggcccactttctggttcctagatgttcacctccttgctatgtcctcatatcgkgggaggggcaaagggtctctctatctggcctcttttaagcccttaacccattcatgaaggctttgcctcaatgacctaatcacctcccaaaggccctacc

SEQ ID NO: 28603 - DNA, 201 bp, Homo sapiens
gggtgagatgaacattgattgagcctttacatcggagacactataacaaatgctttgtgtacatcagctctttcaaattaatacaattctactagaggggrcactattagtatccccaatttacagatgaaaaaaatgagggacagagaggttagatgtgtatctaaggtcacatagctcacaaacgacacagcatgcacc

SEQ ID NO: 28604 - DNA, 201 bp, Homo sapiens
cataccatatgctgaaagacttggaatgcaaaaacctaaggccaagggcacttctcaatattaaaccctcagttgtaatggaggcatcaagactataagayccaagaccttaacttttgtgctccttgtcttgtggagggaacatccatcctcaaaacagaaacctgtgagatcccttgaatatactgacaatacactgat

SEQ ID NO: 28605 - DNA, 201 bp, Homo sapiens
ttagaagaaaaccagaggtctgtgcacactatggatttttactacaatgatgccctttcacatacagcgagaaggattaagaggtactgtattgttggttrataaagtcaaacttgtgaacagagcaaaagggcattgcttggtcattgcagcttccacccatgcaccttacacagaagtttgggccctaacatggaaact

SEQ ID NO: 28606 - DNA, 201 bp, Homo sapiens
cccctgtgggcttagaagaaaaccagaggtctgtgcacactatggatttttactacaatgatgccctttcacatacagcgagaaggattaagaggtactgwattgttggttgataaagtcaaacttgtgaacagagcaaaagggcattgcttggtcattgcagcttccacccatgcaccttacacagaagtttgggcccta

SEQ ID NO: 28607 - DNA, 201 bp, Homo sapiens
gtgggaatgtctcatccccctgtgggcttagaagaaaaccagaggtctgtgcacactatggatttttactacaatgatgccctttcacatacagcgagaargattaagaggtactgtattgttggttgataaagtcaaacttgtgaacagagcaaaagggcattgcttggtcattgcagcttccacccatgcaccttacac

SEQ ID NO: 28608 - DNA, 201 bp, Homo sapiens
ggaggagactttgactctagatgacatgatgtaccctgtgttctgcaagctggagaacatcatgtagaatctgaaaattaggagagagaggcaatcagaaraagacagagtggtgttgcagggacctgcagtcagcctagtcccccagtttgcgtttgaatttggtcccagattttttttgtttttgttttttagtagtta

SEQ ID NO: 28609 - DNA, 201 bp, Homo sapiens
ggtgccattttcctgactgtagatacttgggtaaggaggagactttgactctagatgacatgatgtaccctgtgttctgcaagctggagaacatcatgtaraatctgaaaattaggagagagaggcaatcagaagaagacagagtggtgttgcagggacctgcagtcagcctagtcccccagtttgcgtttgaatttggtc

SEQ ID NO: 28610 - DNA, 201 bp, Homo sapiens
attcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacat

SEQ ID NO: 28611 - DNA, 201 bp, Homo sapiens
caaatcagacaccaacataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaa

SEQ ID NO: 28612 - DNA, 201 bp, Homo sapiens
gcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgta

SEQ ID NO: 28613 - DNA, 201 bp, Homo sapiens
gttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctca

SEQ ID NO: 28614 - DNA, 201 bp, Homo sapiens
gtgcttgctttgggagttcttgttaaccctgacaattcttgtcaaatatcttactcctgggctgtgctggggatggcagcagagtggggtggttggatggraaggcgggaaagagctagcttggagatgatacgcttttccatccttgaataacttgggaaaaagtcaggagtgtggaatgaagaattggaatataaaggc

SEQ ID NO: 28615 - DNA, 201 bp, Homo sapiens
ctgtccttactgtttcccttgggcacgctgttcaccccttaggacatactacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcagg

SEQ ID NO: 28616 - DNA, 201 bp, Homo sapiens
caatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcgcaatc

SEQ ID NO: 28617 - DNA, 201 bp, Homo sapiens
aattatagctcaaatttaattaaaatagcttttattgcttctattcatgtgtccctggattttaagtgatgcatcagaatttcatgatgagcaaatgcctrtggatgccctcatttctcatccttcttgactgtctgctaagattcactcttggtcttgtctttgagcttttctgttcagtgatgtaatgggacaggctct

SEQ ID NO: 28618 - DNA, 201 bp, Homo sapiens
aagtaccaaaacaaaacaagaaacccagaattatagctcaaatttaattaaaatagcttttattgcttctattcatgtgtccctggattttaagtgatgcrtcagaatttcatgatgagcaaatgcctatggatgccctcatttctcatccttcttgactgtctgctaagattcactcttggtcttgtctttgagcttttc

SEQ ID NO: 28619 - DNA, 201 bp, Homo sapiens
gacagatgaatactcagggttttttttttttttttcttctaacttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtga

SEQ ID NO: 28620 - DNA, 201 bp, Homo sapiens
tacagtgccagtgggcagaaggttttgcaagaatagcttcaggaagactttgtgggaagacagatgaatactcagggttttttttttttttttcttctaayttgtcctccttgatcaggatttctcaaatgcacatttgtctaatatactgttgaaccatgcaagtaccaaaacaaaacaagaaacccagaattatagctc

SEQ ID NO: 28621 - DNA, 201 bp, Homo sapiens
tgatcctattcgcatgataaaaatcataatgtctcaaattacttactcaataaaatgtgggtttgtctattattagtgattattagggttataatgcagcrtggaaatttggagcaaattaactatacatgcaagctgttgggctcaagtgcagttaatcatacgcatacagtgccagtgggcagaaggttttgcaagaat

SEQ ID NO: 28622 - DNA, 201 bp, Homo sapiens
ctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagt

SEQ ID NO: 28623 - DNA, 201 bp, Homo sapiens
attagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaag

SEQ ID NO: 28624 - DNA, 201 bp, Homo sapiens
ctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacgattcagagaaatgctctgccttcttgtct

SEQ ID NO: 28625 - DNA, 201 bp, Homo sapiens
caaacatgtaataccaccctggtcttcaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaag

SEQ ID NO: 28626 - DNA, 201 bp, Homo sapiens
tcccaattagtttcttcatgccataaggacaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagaggcaacattgtttgtgcttagaaggaa

SEQ ID NO: 28627 - DNA, 201 bp, Homo sapiens
tggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttcaagtccactctcaaaaaaaaaaaaaaat

SEQ ID NO: 28628 - DNA, 201 bp, Homo sapiens
gggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttg

SEQ ID NO: 28629 - DNA, 201 bp, Homo sapiens
cctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaaaaaaaagcctgtcatagt

SEQ ID NO: 28630 - DNA, 201 bp, Homo sapiens
tcttgagcagccatgcctgcttccgaggtggtgctgcatgctattcaggaggacagaccatggatgggaatcctgagccacaactccttagcctcatgacrttgggcagatgactgagcttgtctgagttacaataaataaaaataccatgctgaatgatggcctagcatgacattgggaagtacagactttgcaggcagg

SEQ ID NO: 28631 - DNA, 201 bp, Homo sapiens
atccactggggttcggaatacaactgccctgcctcttgagcagccatgcctgcttccgaggtggtgctgcatgctattcaggaggacagaccatggatggraatcctgagccacaactccttagcctcatgacgttgggcagatgactgagcttgtctgagttacaataaataaaaataccatgctgaatgatggcctagc

SEQ ID NO: 28632 - DNA, 201 bp, Homo sapiens
ggcctcttgttcttcttcagctgttcctcagacatgccaggtgtgttcctgtctcagacgctttgcctttgctgctccttctgcctggagtattcttccaygtagcaccatgagctgttcttctccaaaaggctttgctcaactgacactttctcagtgaagctgtttctcaccactcactataaaatggcagcctgcctc

SEQ ID NO: 28633 - DNA, 201 bp, Homo sapiens
tgacagtccacttcattaagtggaggacagtgttttgattgctatttaatctgtttttccttctgtctgttcttggctatatggaattcactttgcctctsttcccgactcttcatatcccttatctcaaggtgagtatcgtcagaatcccggtacatttcaccagccaccttttatagaagcttagaaagatggaggcaa

SEQ ID NO: 28634 - DNA, 201 bp, Homo sapiens
cactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaac

SEQ ID NO: 28635 - DNA, 201 bp, Homo sapiens
ttgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaa

SEQ ID NO: 28636 - DNA, 201 bp, Homo sapiens
ttcctacattcaacattgtactctaatatccagtaaagtgaaacaaacaaacaaataaatacacttttttcaagaaaaaataaatatctgtgatctcatcrtttgaccgtcagtattttcatttttgcatgtgccactttaatttccctaggcaacactagctagtggcccacaataagacgtagaaaacaagaccacgta

SEQ ID NO: 28637 - DNA, 201 bp, Homo sapiens
acccacagaacactggctcctcatcacctccccaagcccagcccctggcaaccaccattctcccctactttgtctatgaattcgactactcttggtacctyatataagtggaatcacacagtgtgtgatgtgttcttttgtggctgacttatttatgatactggattctcagcatcatgggagttaggactgtctgtcgca

SEQ ID NO: 28638 - DNA, 201 bp, Homo sapiens
tgaccatccatctccagaatgattttcatcgtgcaaaactgaaacgctgtacccacagaacactggctcctcatcacctccccaagcccagcccctggcarccaccattctcccctactttgtctatgaattcgactactcttggtacctcatataagtggaatcacacagtgtgtgatgtgttcttttgtggctgactta

SEQ ID NO: 28639 - DNA, 201 bp, Homo sapiens
gggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaa

SEQ ID NO: 28640 - DNA, 201 bp, Homo sapiens
aaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaattt

SEQ ID NO: 28641 - DNA, 201 bp, Homo sapiens
tccccgttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctacccaagtaatgactcatccttttataca

SEQ ID NO: 28642 - DNA, 201 bp, Homo sapiens
ctgatgtctcagcttgaagtcaggcatagagaggcaattctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatat

SEQ ID NO: 28643 - DNA, 201 bp, Homo sapiens
gtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacata

SEQ ID NO: 28644 - DNA, 201 bp, Homo sapiens
caggtgggaacagggttacagagcaaagtaattagatgccctttagatgctcttagttaaagaccatgcaaaaaggatgaaatcttttgatcatgttcttyacaatattagaggtaaaacatgaactcaacgcttttaggaagaaacaactggattgcgttttctattttattgacagaaactagatggggaggccagggt

SEQ ID NO: 28645 - DNA, 201 bp, Homo sapiens
aatatagtttgctgtgtgctgggtgggtgggagggagcgtccacattagtgaacagccaggcagtcgctgcctcaaatttctttagggttatcctttcatkccagcaattgaatttgatttgcactgtttcacttctctacaagggtgtaaaaagtagaggttcctcttgaaagaatttcctccccatctaattaggaata

SEQ ID NO: 28646 - DNA, 201 bp, Homo sapiens
cacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatct

SEQ ID NO: 28647 - DNA, 201 bp, Homo sapiens
agtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccg

SEQ ID NO: 28648 - DNA, 201 bp, Homo sapiens
ccacaggacactactgtgcatttgcctgtgatttgccattgggttggagtacttctcctgagtttctgcagtgttctaggtatggtcttaggccctggaawaagacagtgtaggaaacacagaaggtgcctgatttcctgggcctagctaaggggaaaaagcgagacaatggggtcagaggaagctcagctgaacagatga

SEQ ID NO: 28649 - DNA, 201 bp, Homo sapiens
gccacaggacactactgtgcatttgcctgtgatttgccattgggttggagtacttctcctgagtttctgcagtgttctaggtatggtcttaggccctggartaagacagtgtaggaaacacagaaggtgcctgatttcctgggcctagctaaggggaaaaagcgagacaatggggtcagaggaagctcagctgaacagatg

SEQ ID NO: 28650 - DNA, 201 bp, Homo sapiens
tcagttggcatgcgatatgcttctcaggcagtaatttagagactgtcaattcctgagagccgctggggaactgagcaatcgtctgcatttcgtcgctttarcccgagctgggtctttgagctggcagagaccaagatctttttctgggaagggatggtcctatttaaggaaggccctggattttgtcaagtttgaaaggtt

SEQ ID NO: 28651 - DNA, 201 bp, Homo sapiens
cagggacagcaaaagcacacacaatgatggccagagacactgctcagtgtactgtcttccaccgggacagcccactcaccaagggttaggtcctgtgctgmctgggtcccgggtctcctcggaggtcggtttgcatcacgtggatacactaatctacccaagttgacttggagaaccaatctgaaatcagatgggagctcc

SEQ ID NO: 28652 - DNA, 201 bp, Homo sapiens
atctgccagcaggctgtgctggggagtggtgagtagtacagggatgtgtctgaccccaggagaactgccccgatccctatcttgtctctgctcagttctgrtaactcttttatcttccctggagttatttttttcccttctttctttctctttttctgtgtgctcttctaagagtaaaacgcatgtccccccatgaagtca

SEQ ID NO: 28653 - DNA, 201 bp, Homo sapiens
gattccagcattttgggaggccaaggtggacggatcaccagagttcaggagtttgagaccagcctggccaaaatggtgaaatgccatctctactaaaaacmcaaaaattagctgggtgtgtggtagtgtgtgcctgtagtcccagctactctggatgctgaggcacgagaattgcttgaacctgggagtaggaggctgcag

SEQ ID NO: 28654 - DNA, 201 bp, Homo sapiens
tggatttgtcccattacactgctttctttagtgcataagatcttgaagggagggatgcattctatgcaccccaagtttctggtttactcgtggtttcaggwgtccctttagacaacatcactgacaactcactatgtaaaaccaaacaaattattagctttcttactgtgtgtttgcatttgctgtgcccagggaaatggg

SEQ ID NO: 28655 - DNA, 201 bp, Homo sapiens
actatgtaaaaccaaacaaattattagctttcttactgtgtgtttgcatttgctgtgcccagggaaatgggaagtgcattgaggaagaggccccaagacawggagaagtcactccaactttccgggaacaccttttgctgtgccatgtgcatggaaggagaggaatgaatgactgttgaagccagatggccttgctcattg

SEQ ID NO: 28656 - DNA, 201 bp, Homo sapiens
agctttcttactgtgtgtttgcatttgctgtgcccagggaaatgggaagtgcattgaggaagaggccccaagacaaggagaagtcactccaactttccggraacaccttttgctgtgccatgtgcatggaaggagaggaatgaatgactgttgaagccagatggccttgctcattgattctctcctttcccgccctctcaa

SEQ ID NO: 28657 - DNA, 201 bp, Homo sapiens
ttcttactgtgtgtttgcatttgctgtgcccagggaaatgggaagtgcattgaggaagaggccccaagacaaggagaagtcactccaactttccgggaacmccttttgctgtgccatgtgcatggaaggagaggaatgaatgactgttgaagccagatggccttgctcattgattctctcctttcccgccctctcaagcca

SEQ ID NO: 28658 - DNA, 201 bp, Homo sapiens
tgaagccagatggccttgctcattgattctctcctttcccgccctctcaagccatccagaaggagaatgaaatgctcaaatcaagggagttaactatggcmaagatgttagtaatgggaaactttggaggaaggcaaagtcagaaattattctgcagggagatttggggatgttggatgctaaggcccaagccgtctattg

SEQ ID NO: 28659 - DNA, 201 bp, Homo sapiens
tctggcaaaaatggttttattgtagtttcatccttgttgagtcaataattaactgagtttgattaaagctgaattttcctaagtatgaaaaccatgtgggyccttctctttcctcgtgatgcacggtgatagtgcgtatctaacacttgaaggtgtccacgctggccctagctcagtgagatggctttgctttgggggggt

SEQ ID NO: 28660 - DNA, 201 bp, Homo sapiens
cccctggctgtccaccagcccctttgtgatagtctcatagtcttatttgtcttttggcttgtatcccacctgttcactttttaccatagctaacctttctmagtggtcaggtgggactcatggagattttccgttctttggagactagcagcgactgcagattactcatcagctgtctccttgagtccacaatgccgggcg

SEQ ID NO: 28661 - DNA, 201 bp, Homo sapiens
ggacccggttggctctgcaaaccgcatttccttggctgaacgccagaggagagaaatgatccggcaagaagacacaccattccccgtcagccccttcccgwcccttgcacccctggatcttctgctgagtatcggattggtctgcgtccaagagctcctcgcttggccagcaggggctgcctggagaaggggaggacaggc

SEQ ID NO: 28662 - DNA, 201 bp, Homo sapiens
ggcgcgatctccactcaccgcaagctccgcctcctgagttcaactgattctcctgcctccgcttcccaagtacctgggattatagacacccaccaccatgyacagctaatttttgtatttttagtagagatggagtttcacccttttgattggttggccagtatggtctcaaactcctgacctcaagtgatccacctgcct

SEQ ID NO: 28663 - DNA, 201 bp, Homo sapiens
aaatattttgagaactctgaaataatgcacaccagaaacgtccagctgaaaacaaaaagggaacaagatgacattttgcaatcccatgcacgttgcaggcrcgttgaatgtgaaggtcagtagtacttcagagggcaggcctgttgcccccaagcctgttgcctaagaaatgcccaggccctttgaacaaaatggattcga

SEQ ID NO: 28664 - DNA, 201 bp, Homo sapiens
atgaaaagaagttgtatcaaacttgctgggcatcagaaataaagggttttagagacactggcttcaaacacaagttattccatccaagattctaaacttarcaatgcaacttgcacttaattttaaaacgctggaaaaataatgataaagattgtgtgatcaagtatagcagccctgtggtgtttcctcagaatggtgtat

SEQ ID NO: 28665 - DNA, 201 bp, Homo sapiens
ccgatatttaatattatcaattgctggttcctgtaaatttgcatttatggatcacattataaaagcaattactcttatggattgttcatgcagaaatgcaytatgatgataatatacttttaaaagtatatttatttccagaattcaatttgtaagaggtttgagggaaaaataatactgagttttgagtgtttctgattt

SEQ ID NO: 28666 - DNA, 201 bp, Homo sapiens
tattatcaattgctggttcctgtaaatttgcatttatggatcacattataaaagcaattactcttatggattgttcatgcagaaatgcactatgatgatamtatacttttaaaagtatatttatttccagaattcaatttgtaagaggtttgagggaaaaataatactgagttttgagtgtttctgattttaaaaatgtgt

SEQ ID NO: 28667 - DNA, 201 bp, Homo sapiens
cttttcaagtatcttactgtatgatggttgcttttgggttgaattccaccttgggttcaattcaacatgaaagttaaccttttggtgaaggaatgatccasgggaaatagtaaaatattagcctgtcctccaatacaaattgcctgtgagtcccactgatacttacaaatatacagaggtggtgtaaaaggattctgtgtc

SEQ ID NO: 28668 - DNA, 201 bp, Homo sapiens
ggtggtgtaaaaggattctgtgtcaaaactattaatatttgagaaatacaatacttatcagagcctttgtatgtaaatgtctcatatacccctctaagaasgggagcgaatagtattttccaaacttacgtcaccacttaccatccacctgcatactttacacgtcttggaatcaaccttacagggaacacttggtcgaaa

SEQ ID NO: 28669 - DNA, 201 bp, Homo sapiens
cctttgtatgtaaatgtctcatatacccctctaagaacgggagcgaatagtattttccaaacttacgtcaccacttaccatccacctgcatactttacacrtcttggaatcaaccttacagggaacacttggtcgaaaaacagtgttttctaaatttatattacagttcccactccccccgcccccacttgtatcactttg

SEQ ID NO: 28670 - DNA, 201 bp, Homo sapiens
tccacctgcatactttacacgtcttggaatcaaccttacagggaacacttggtcgaaaaacagtgttttctaaatttatattacagttcccactccccccscccccacttgtatcactttgtatgacagtcttcttgggaacatccattgggaaactcttcccttgcaggtgtctgttacaagtcctggttcacacagtgt

SEQ ID NO: 28671 - DNA, 201 bp, Homo sapiens
gatcacctgaagtcaggacatcaagaccagcctggccagtgtggcaaaaccccacctctactaaaaatacaaaaaaaaattagctgaacctggtggttcaygcctgtaattgcagctactcaggaggctgaggcaggagaatcacttgaacccgggaggcggaggttacagtgaaccgagatcgtgtcactgcactccagc

SEQ ID NO: 28672 - DNA, 201 bp, Homo sapiens
cgcctgtaattgcagctactcaggaggctgaggcaggagaatcacttgaacccgggaggcggaggttacagtgaaccgagatcgtgtcactgcactccagmctaggcgacagagcgagaccctgtctcagaaacagaaaataaaacaaacaaaaaaatactattccatagctgactattttctgaaatgattttgttactt

SEQ ID NO: 28673 - DNA, 201 bp, Homo sapiens
tactagtgagtggcagatatgtgtggaccacagagatggactgaaaagagaagtaacagtccttggtttgtattccagcccccaccttcctatgtctttgrgcttggtaattagatgcttggagcttcagtttccccatctgttggatcagaacggcagtatgtgctctccagtattttcataagagtcacatgaaatatg

SEQ ID NO: 28674 - DNA, 201 bp, Homo sapiens
agtattttcataagagtcacatgaaatatgtacctacagagtctatcactgtgctttttaagttggggcttaatatgtggtagttgttgctgtttttgttrttattattattaatgttattttttgtttgtttgttttttgagatggagtcttgctctgtcacccaggctgaagtgcagtggcgtgatctcaactcaccgc

SEQ ID NO: 28675 - DNA, 201 bp, Homo sapiens
tgttattattattaatgttattttttgtttgtttgttttttgagatggagtcttgctctgtcacccaggctgaagtgcagtggcgtgatctcaactcacckcagcctccgcctcctgggatcaagtgattctcctgcctcagcctcccgagtagctgggactataggcacctggctaatttttgtattttatattagagat

SEQ ID NO: 28676 - DNA, 201 bp, Homo sapiens
acgtgagtgaccacgcctggcccataaatgttatctttatataacatactcacagctcccttaggagtacttttgtccatttctacacaatggaaacttayaattttagccttagcaacatgtatttactgggcatctagatttcatttatttaagaactttttattgaatgccgattgttcagcagccaccatgcaaggt

SEQ ID NO: 28677 - DNA, 201 bp, Homo sapiens
gaaaaaaacttgcttgtttactgtcttctgagctgatttctcacctactggcaagtggataggtctactttttgtttagctgtttttctaatttaatcttrtacatgagacagctatagatggatgtatagtctttgaagtggggccagttggctccgtctattagctgtgtggcttttgtgcaggtgacttgtggccccc

SEQ ID NO: 28678 - DNA, 201 bp, Homo sapiens
caacactaataagtaattgagcagatgagatgctcttgctagctttggtaaaaagtcggggcaaggttacaacagaggagctctgatgagacttgggatgrtaaagtcaagtcgaatatctggtagggttaaaaatctaacagtgggccaggcgcagtggctcacgcctgtaatcacggcactttgggaggccaaggcagg

SEQ ID NO: 28679 - DNA, 201 bp, Homo sapiens
tcctgggctcaagcaatccgcccacctcggcctcccaaagtgctgggattacaggcatgagccactgtacctggactccactatgccttcccctccccttycctcccttccccaccctaaagagtctcgctcttttccccaggctggagtgcagtggcactatctgggctcactgcaacctgtgcctcccggattcaagag

SEQ ID NO: 28680 - DNA, 201 bp, Homo sapiens
ctctcctcggccttgcaaagtgctgggattataggtaccccgcctggctgatactttccttagttgttttcagtgtaataacctgtcttcagtctactctwtgtccttttctctcctttcctccctgaatactcaagcttccagtgcacagatttctccaaccctgaatgtgactgataccaacaccatactagctcttcc

SEQ ID NO: 28681 - DNA, 201 bp, Homo sapiens
tttgctctgttacgtgaggacacatcacttgcacctcagtgtgagtttgaaagtgttttctctggagaataattctgaagaaataggccctccagatatcrgtagtgacaggggtatcagtaatgttgattactaagttcttgccacaggtagaagccatgctactgcacaagtttcatacttgaagagtggacatctgac

SEQ ID NO: 28682 - DNA, 201 bp, Homo sapiens
tatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaat

SEQ ID NO: 28683 - DNA, 201 bp, Homo sapiens
gtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatga

SEQ ID NO: 28684 - DNA, 201 bp, Homo sapiens
gtgagccaccacacccagcctgggggagggtttgttaaagaactgtctgttttatcacatgaccacaagttaaaatgttgggcaatgtccctgaatgataycttttcattagtaactcacatggacccataatctctgaatttaacatgcttttcaggaatgtgttcatattttccacctataaaacctgttttagtaatt

SEQ ID NO: 28685 - DNA, 201 bp, Homo sapiens
ggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaact

SEQ ID NO: 28686 - DNA, 201 bp, Homo sapiens
atttaagaactggtactatgaagacatttcccttatgcaatttgttttccatctaagagcagaacaaggaaaatatagctgactataagttacaaaggcavactcttaagctacaaaatacatctcttcacaggagcacttggagaagggctgaaggcaaaccaaaagtgagcaacaaggagactagtgttctgaaacaga

SEQ ID NO: 28687 - DNA, 201 bp, Homo sapiens
ttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttc

SEQ ID NO: 28688 - DNA, 201 bp, Homo sapiens
tctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagct

SEQ ID NO: 28689 - DNA, 201 bp, Homo sapiens
gactattaaaatgtaaattaattaaaattaaaagttcaattgctctgaaatagcagccacatttcaaatcttcagtagccagatgtggttattggctaccwtattgggtagcaccgatatagaacatttctaccatagtagaatgctcttttggatacatctgctttaaagcattagtccccaaagtgtgaaggatgaacc

SEQ ID NO: 28690 - DNA, 201 bp, Homo sapiens
gtcccgtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtg

SEQ ID NO: 28691 - DNA, 201 bp, Homo sapiens
tggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatgcatgagtgtgttagactgcttttctt

SEQ ID NO: 28692 - DNA, 201 bp, Homo sapiens
tcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatg

SEQ ID NO: 28693 - DNA, 201 bp, Homo sapiens
ctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataac

SEQ ID NO: 28694 - DNA, 201 bp, Homo sapiens
ggctctccatccttcaaaatccagctcttggcctcatatcttccacaaagccttcccagacctttactcacctgggccattaatcaccttccctctcagtyagctcctacaccatgagtgcttttgtatggtgactgtctggttacaaggtcatcttttcccctggatgagacgccccttggggaaaggaccaagttttat

SEQ ID NO: 28695 - DNA, 201 bp, Homo sapiens
tccatccttcaaaatccagctcttggcctcatatcttccacaaagccttcccagacctttactcacctgggccattaatcaccttccctctcagtcagctsctacaccatgagtgcttttgtatggtgactgtctggttacaaggtcatcttttcccctggatgagacgccccttggggaaaggaccaagttttattccct

SEQ ID NO: 28696 - DNA, 201 bp, Homo sapiens
ggcctcatatcttccacaaagccttcccagacctttactcacctgggccattaatcaccttccctctcagtcagctcctacaccatgagtgcttttgtatsgtgactgtctggttacaaggtcatcttttcccctggatgagacgccccttggggaaaggaccaagttttattccctgtttaaccttggcctgacaaccta

SEQ ID NO: 28697 - DNA, 201 bp, Homo sapiens
cgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtat

SEQ ID NO: 28698 - DNA, 201 bp, Homo sapiens
aaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatg

SEQ ID NO: 28699 - DNA, 201 bp, Homo sapiens
cctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggac

SEQ ID NO: 28700 - DNA, 201 bp, Homo sapiens
attctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagc

SEQ ID NO: 28701 - DNA, 201 bp, Homo sapiens
ccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatct

SEQ ID NO: 28702 - DNA, 201 bp, Homo sapiens
agatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactct

SEQ ID NO: 28703 - DNA, 201 bp, Homo sapiens
tcctttcacaataaccctatccttactgttgaagacttgtggaaaagggacatggcccagggaaccagagtggtttgggaaagcactttgtcaagaggctkggggaccccagggtggaagctgccatgcgcatgaggctgtgttagcagaggcagtggcagaagaagacattgcaaacctgcaaaagcaacctctgaggat

SEQ ID NO: 28704 - DNA, 201 bp, Homo sapiens
gcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggcttggggaccccagggtggaagctgccatgcgcatgaggctg

SEQ ID NO: 28705 - DNA, 201 bp, Homo sapiens
ccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcac

SEQ ID NO: 28706 - DNA, 201 bp, Homo sapiens
caaaccaggtgtcattgccctccccaccctaccttgctcccctggagtgtatcctgattcttttgaggatcacttgatcctgattttttttttatgtgtawagatgggatttcattatattgcccagactggtcttaaactcctggcctcaagcaatccagccacctcggcctcccaaagtgctgggattataggcttgaa

SEQ ID NO: 28707 - DNA, 201 bp, Homo sapiens
cgaatatttgggacccactgggagtttgtgccaaaccaggtgtcattgccctccccaccctaccttgctcccctggagtgtatcctgattcttttgaggawcacttgatcctgattttttttttatgtgtatagatgggatttcattatattgcccagactggtcttaaactcctggcctcaagcaatccagccacctcgg

SEQ ID NO: 28708 - DNA, 201 bp, Homo sapiens
ctttagccaaggaagaaatgacaacgaatatttgggacccactgggagtttgtgccaaaccaggtgtcattgccctccccaccctaccttgctcccctggrgtgtatcctgattcttttgaggatcacttgatcctgattttttttttatgtgtatagatgggatttcattatattgcccagactggtcttaaactcctgg

SEQ ID NO: 28709 - DNA, 201 bp, Homo sapiens
tgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactcaaagaagat

SEQ ID NO: 28710 - DNA, 201 bp, Homo sapiens
caagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctct

SEQ ID NO: 28711 - DNA, 201 bp, Homo sapiens
taaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaa

SEQ ID NO: 28712 - DNA, 201 bp, Homo sapiens
tgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaa

SEQ ID NO: 28713 - DNA, 201 bp, Homo sapiens
aaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgat

SEQ ID NO: 28714 - DNA, 201 bp, Homo sapiens
aaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggg

SEQ ID NO: 28715 - DNA, 201 bp, Homo sapiens
agaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttg

SEQ ID NO: 28716 - DNA, 201 bp, Homo sapiens
gaaacaattcagcaactctcttacagatttttatcatcatcccattcataattgattccaaacgtgcatgaatctttcaagataagtgtcttattgattaycctgaaaacaagcgatcacttggtgtcctgagattcgctcactgccctcccctgattaccgtaaacagagatgttgatgagaagaaatgtcactttcttt

SEQ ID NO: 28717 - DNA, 201 bp, Homo sapiens
ccttttttagagataaagcctcaccctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctct

SEQ ID NO: 28718 - DNA, 201 bp, Homo sapiens
tatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctcttacctcagcctcttgagtggctg

SEQ ID NO: 28719 - DNA, 201 bp, Homo sapiens
tcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaa

SEQ ID NO: 28720 - DNA, 201 bp, Homo sapiens
ataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttaatctaagagctttcttggttattttctgttcttaatc

SEQ ID NO: 28721 - DNA, 201 bp, Homo sapiens
gaacaaattgccaaatgcaaggcctgagcaaaagacacagaaaggatttctttatcgtaagcacacttctctacattacctttataatccaacaactctgstattagtaaattatagaaacaacttttgtaacactatcttgtttgcagagtatatgaaaaatttgaagttaaaattcagctccacgaatactgcagtggt

SEQ ID NO: 28722 - DNA, 201 bp, Homo sapiens
ttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtctt

SEQ ID NO: 28723 - DNA, 201 bp, Homo sapiens
gaaggatcatgggaggggaggagcgtgagttcctcttaagtgaatataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaa

SEQ ID NO: 28724 - DNA, 201 bp, Homo sapiens
gtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgttttt

SEQ ID NO: 28725 - DNA, 201 bp, Homo sapiens
aattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcc

SEQ ID NO: 28726 - DNA, 201 bp, Homo sapiens
ggtgagaaggagctggcagtgtgaatagccaggggaaaagtgttttgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatct

SEQ ID NO: 28727 - DNA, 201 bp, Homo sapiens
gaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcattgctgaagagactatgttgcccagatgacttgttcatgtaatctg

SEQ ID NO: 28728 - DNA, 201 bp, Homo sapiens
actgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaa

SEQ ID NO: 28729 - DNA, 201 bp, Homo sapiens
gttggagaaaagggggaaaaagttaaatgttaatgattcttttcgtaactgcaattttatcggctcctttttgtacatatatgattatgaagcaatttgcrtgaaatttacaccttttcaaattttgaaaattgccttgttgaaaaagaatcgctgtacttctcaatactacactgattaatcacagttatagagtagaca

SEQ ID NO: 28730 - DNA, 201 bp, Homo sapiens
agttggagaaaagggggaaaaagttaaatgttaatgattcttttcgtaactgcaattttatcggctcctttttgtacatatatgattatgaagcaatttgyatgaaatttacaccttttcaaattttgaaaattgccttgttgaaaaagaatcgctgtacttctcaatactacactgattaatcacagttatagagtagac

SEQ ID NO: 28731 - DNA, 201 bp, Homo sapiens
ctgtagcaaagatgtactgtttcccactgagaagaatcaaaaatagaaaagtgcttccttgtctctctatattgttattaaaacaagtagatgcattttcrttgaatcaaggcagttttcctttataaaatgtcctatttcatatcactgttcaaacttgacatccacatttgagttggtttaaaatatcactgttttgtt

SEQ ID NO: 28732 - DNA, 201 bp, Homo sapiens
agttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccctgctgc

SEQ ID NO: 28733 - DNA, 201 bp, Homo sapiens
tgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaag

SEQ ID NO: 28734 - DNA, 201 bp, Homo sapiens
caagttcaaaatcagtctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtccc

SEQ ID NO: 28735 - DNA, 201 bp, Homo sapiens
gatagctgatttgttataaacaaattaccaaaaacgtactggctttaaacaacacatgcttatcatgttgcagttctggggagtcacaagttcaaaatcastctcacctggtcaagatgtcagtagggcttgttccttctggaggctctaggggagaatctgtttccttgcgtttttcatcttctagaggcctcctgcatt

SEQ ID NO: 28736 - DNA, 201 bp, Homo sapiens
tgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcagtctcacctggtcaagatgtcagtagggcttgttccttctggaggctcta

SEQ ID NO: 28737 - DNA, 201 bp, Homo sapiens
tctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaa

SEQ ID NO: 28738 - DNA, 201 bp, Homo sapiens
atttgtgtcctggttggcagatattaagtccacagataccaataattaatatctatggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgacc

SEQ ID NO: 28739 - DNA, 201 bp, Homo sapiens
tatccaggaggaatgattagtgatctgattcattaatatcccttgttattaagaactgtctgtatttgtgtcctggttggcagatattaagtccacagatwccaataattaatatctatggttgattgtaaaaatggccaccaattcttccctgtcccctgcatatgtacatccttgcactgtgaaattgtagatctcgcc

SEQ ID NO: 28740 - DNA, 201 bp, Homo sapiens
gttcaggaacagaactgacaggtattgaagccaaaaattgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaac

SEQ ID NO: 28741 - DNA, 201 bp, Homo sapiens
ttatttcttttcaatactctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcgtgtgggtgaacacacacacacacacacacacacgctt

SEQ ID NO: 28742 - DNA, 201 bp, Homo sapiens
ttgacaatactttcctttcagtctattttcctgtgtatggggtaagtgttgcccttctgcaactttccttttattttatttatttatttcttttcaatackctgaatatcactggagcagctgcagattcagggcagtatggggtggttcaggaacagaactgacaggtattgaagccaaaaattgaacaataacaacgta

SEQ ID NO: 28743 - DNA, 201 bp, Homo sapiens
ttggagaggcctgtttccatacatagctctttgtcagttgctcacactcggtcaatacttgccttcctttgaggccatctgcactcactgacaatctgatygctcccctgaatggaggtgaaagcatgcaagctaggagttaagatctttaactcagggaagaccctgtctatggaagtgctgagctcttcagtgtcatca

SEQ ID NO: 28744 - DNA, 201 bp, Homo sapiens
tctctggaaatctctagcttctcaaactgtttcgtggtggagtgccttttgggcacaggagaaggaaataagagcctcgcgaggtttgggaatgctgcctstagctctcacactgcatgcagaattcctactctgagagctcactttatctcaaaaacccatgcatattctgcatctactctgaattccgcagtgttgtgt

SEQ ID NO: 28745 - DNA, 201 bp, Homo sapiens
tctgactttccttgactttgatgtctaggtctggatttcaagggctcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggca

SEQ ID NO: 28746 - DNA, 201 bp, Homo sapiens
ccaagctcattcaggatgctggcaggattcagatccttgaagttgtaagactagggcccctgtttcctactgacttctgctggtggctgccctcagctccsagaggcaacccacattccttgacttttggccccctgcatctcaaagccagcaacagaaactctcttgtgcatggagtcccctcctgctttgaatctctct

SEQ ID NO: 28747 - DNA, 201 bp, Homo sapiens
tcccttgaacctgggaggtggaggttgcagtgagctgagatcacgccattatactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgt

SEQ ID NO: 28748 - DNA, 201 bp, Homo sapiens
ggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattatactccagtct

SEQ ID NO: 28749 - DNA, 201 bp, Homo sapiens
cgtgtgaatgtattgcagaaatggacaggacaattctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattt

SEQ ID NO: 28750 - DNA, 201 bp, Homo sapiens
tgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttgg

SEQ ID NO: 28751 - DNA, 201 bp, Homo sapiens
gtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtga

SEQ ID NO: 28752 - DNA, 201 bp, Homo sapiens
tttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggct

SEQ ID NO: 28753 - DNA, 201 bp, Homo sapiens
tgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgctttt

SEQ ID NO: 28754 - DNA, 201 bp, Homo sapiens
cagcctcccaaagtgcagggattaaggcgtgagccaccgagcccagccggcaaacttactttaaaacacattgcaataaaataaaaagaaaagggattgtsctaagtgagaagcagagatgaaaatgtggaaggatgattgtgagaagtccacattgctccatttggacttcctttttgtagtgggctattagattttgcc

SEQ ID NO: 28755 - DNA, 201 bp, Homo sapiens
aggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtcctaagtgagaagcagagatgaaaatgtggaaggatgattgtgagaagtccacattgct

SEQ ID NO: 28756 - DNA, 201 bp, Homo sapiens
ctacccccgcccccgggttcaagcaattgtcgcacctcagcctcccaagtaactgggattacaggtgcccaccaccaagcccggctaatttttctattttmaatagagatgaggttttgccatattggtcaggctggtcttgaactcttgacctcaggtgattcacccacctcagcctcccaaagtgcagggattaaggcg

SEQ ID NO: 28757 - DNA, 201 bp, Homo sapiens
tatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaatttttctattttcaatagagatgaggttttgccatattggt

SEQ ID NO: 28758 - DNA, 201 bp, Homo sapiens
cctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatc

SEQ ID NO: 28759 - DNA, 201 bp, Homo sapiens
caggttttaggcaataataagtgagcagtatggcgccctaatagaaggagggatgcctgtggccaatatacacggctcaaagttgaccatgatagagaagytttccctagaaggtctgtgagggaggaggcctgggagagacagcagggtgaccagagtaagtgaagtcaccgaggtgccaatgagtgtggccctgcaggt

SEQ ID NO: 28760 - DNA, 201 bp, Homo sapiens
gcaggttttaggcaataataagtgagcagtatggcgccctaatagaaggagggatgcctgtggccaatatacacggctcaaagttgaccatgatagagaasctttccctagaaggtctgtgagggaggaggcctgggagagacagcagggtgaccagagtaagtgaagtcaccgaggtgccaatgagtgtggccctgcagg

SEQ ID NO: 28761 - DNA, 201 bp, Homo sapiens
caaatatcttactcctgggctgtgctggggatggcagcagagtggggtggttggatgggaaggcgggaaagagctagcttggagatgatacgcttttccayccttgaataacttgggaaaaagtcaggagtgtggaatgaagaattggaatataaaggctgagggcggacctaattttttttttaaggattaagaaaaaag

SEQ ID NO: 28762 - DNA, 201 bp, Homo sapiens
aggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaaga

SEQ ID NO: 28763 - DNA, 201 bp, Homo sapiens
gaggttgcagtgagctgagatcacaccactgcactccagcctgggtgacagagcaagactgtctcaaaaaaaaaaaaaaaaaaaaaaaaattcaacatacsaattttgcgaggacgcaaacatttaatccgtagtactgatgtggatatgatttgagctaagactctgctgttgattctcttcaaaaacttggcagtagcc

SEQ ID NO: 28764 - DNA, 201 bp, Homo sapiens
ctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaagg

SEQ ID NO: 28765 - DNA, 201 bp, Homo sapiens
gtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgatt

SEQ ID NO: 28766 - DNA, 201 bp, Homo sapiens
tgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccc

SEQ ID NO: 28767 - DNA, 201 bp, Homo sapiens
tggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaa

SEQ ID NO: 28768 - DNA, 201 bp, Homo sapiens
atattaattattaataaaatccaactccttaataatacaatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaa

SEQ ID NO: 28769 - DNA, 201 bp, Homo sapiens
actaatattctctctgactataattgtaaaacagtagatgtctttcaccaagcgctaacattatattaattattaataaaatccaactccttaataatacwatcatagttaccatttattgagagcactcttctgaacattttgcattctttatttaatcttacctacaaccttattaagtagacattatcttcatcttat

SEQ ID NO: 28770 - DNA, 201 bp, Homo sapiens
cctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctt

SEQ ID NO: 28771 - DNA, 201 bp, Homo sapiens
gtggccctgaagagggtgggaatgtctcatccccctgtgggcttagaagaaaaccagaggtctgtgcacactatggatttttactacaatgatgccctttyacatacagcgagaaggattaagaggtactgtattgttggttgataaagtcaaacttgtgaacagagcaaaagggcattgcttggtcattgcagcttccac

SEQ ID NO: 28772 - DNA, 201 bp, Homo sapiens
tacttcttggagaaacctcccaaatttctatcgacactagacatctcaggatttgaaatgttaagctaacaaattgttcatcaggtgtatctccagccctycgtaaacactgccggatggatgaacctacgtaatgatctcctggtgccattttcctgactgtagatacttgggtaaggaggagactttgactctagatga

SEQ ID NO: 28773 - DNA, 201 bp, Homo sapiens
tctagtggatattttgttaaaaaaaaaaaatggggtctcattctgttgccccggctgcagtgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagc

SEQ ID NO: 28774 - DNA, 201 bp, Homo sapiens
ctgagtttctgtggatttctataggctcctgcaaattttatctagtggatattttgttaaaaaaaaaaaatggggtctcattctgttgccccggctgcagwgcagtgacatgatcataactcatggtgacctcaaattcatgagcccaagcgatcttcccacctcagcctgagtagatgggactacaggcatgtgtcacca

SEQ ID NO: 28775 - DNA, 201 bp, Homo sapiens
aattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatca

SEQ ID NO: 28776 - DNA, 201 bp, Homo sapiens
cgagcatgctctgaactcctgaactgctcattctgttctctgagagaattgctcaagctgcagtttatcattatatgcctccaaagactttgtgtttcctrtgtttgacatcgagatagaatttttcataaccctttactagtaataaatttgattgttaagggaccgggttaatcttatttctaataccagcatctgatt

SEQ ID NO: 28777 - DNA, 201 bp, Homo sapiens
gaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctgtgtttgacatcgagatagaatttttc

SEQ ID NO: 28778 - DNA, 201 bp, Homo sapiens
tcacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctg

SEQ ID NO: 28779 - DNA, 201 bp, Homo sapiens
ggttggagaatgttcatatcacattattttggatgtctggggttgcacctggaagctcagatagcaatatctaggcacggctgccagtgctctatacattsacgtttgtttaatattttaatttccccatgagtcttaaacctctgcgtggtgtgcaagttgaggcctggtgtatgcacttcggccacgggctttcccact

SEQ ID NO: 28780 - DNA, 201 bp, Homo sapiens
aagcggggcaaggggttggagaatgttcatatcacattattttggatgtctggggttgcacctggaagctcagatagcaatatctaggcacggctgccagygctctatacattcacgtttgtttaatattttaatttccccatgagtcttaaacctctgcgtggtgtgcaagttgaggcctggtgtatgcacttcggccac

SEQ ID NO: 28781 - DNA, 201 bp, Homo sapiens
tgattgccagtccattctctagccttctgaagaagatagattgtaatctttaattaagctatcactcacaccaaaaaaaaaaaaaaaaaaaaaaaaaaagyggggcaaggggttggagaatgttcatatcacattattttggatgtctggggttgcacctggaagctcagatagcaatatctaggcacggctgccagtgct

SEQ ID NO: 28782 - DNA, 201 bp, Homo sapiens
accacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaa

SEQ ID NO: 28783 - DNA, 201 bp, Homo sapiens
tgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgc

SEQ ID NO: 28784 - DNA, 201 bp, Homo sapiens
attttattttttttgagacagagtctctgtctccaggctggagtgcagtggcacaatctcagctcactgcaacctccacctcccgggttcaagcgattccmctgccctgatcagcttcctgagtagctgggactacaggtgcgcgctatcatgcctggctaattttttgtattttagtagagactgggttccaccatggtg

SEQ ID NO: 28785 - DNA, 201 bp, Homo sapiens
ttttttattttattttattttttttgagacagagtctctgtctccaggctggagtgcagtggcacaatctcagctcactgcaacctccacctcccgggttyaagcgattccactgccctgatcagcttcctgagtagctgggactacaggtgcgcgctatcatgcctggctaattttttgtattttagtagagactgggtt

SEQ ID NO: 28786 - DNA, 201 bp, Homo sapiens
catgattcaattacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacag

SEQ ID NO: 28787 - DNA, 201 bp, Homo sapiens
caggcaagaaagaacttgtgtagggaaactctcccttatgataccgtcagattccttgagacttatttgctattgtgagaacaccttgggaaagacctgcytccatgattcaattacctcccacctggtccctcctgcaacatgtgggaattcaagaagagatttgggtgggtacacagccaaaccatatcaaaaaccatt

SEQ ID NO: 28788 - DNA, 201 bp, Homo sapiens
ggcgacacagtgatggcagaaggtgaaaggcacatctcacatggcagcaggcaagaaagaacttgtgtagggaaactctcccttatgataccgtcagattycttgagacttatttgctattgtgagaacaccttgggaaagacctgcctccatgattcaattacctcccacctggtccctcctgcaacatgtgggaattca

SEQ ID NO: 28789 - DNA, 201 bp, Homo sapiens
gctggggaggcgacacagtgatggcagaaggtgaaaggcacatctcacatggcagcaggcaagaaagaacttgtgtagggaaactctcccttatgataccrtcagattccttgagacttatttgctattgtgagaacaccttgggaaagacctgcctccatgattcaattacctcccacctggtccctcctgcaacatgtg

SEQ ID NO: 28790 - DNA, 201 bp, Homo sapiens
ctagggtgttgataagaaacagcaggcatagttactgggtgattgagaagagtttaacaaaagactatattagtctgttttcatgctactgataaaggcayacccaatactaggtcatttacaaaagaaaaaggtttattggacttacagttccttgtggctggggaggcgacacagtgatggcagaaggtgaaaggcaca

SEQ ID NO: 28791 - DNA, 201 bp, Homo sapiens
tagctagggtgttgataagaaacagcaggcatagttactgggtgattgagaagagtttaacaaaagactatattagtctgttttcatgctactgataaagrcatacccaatactaggtcatttacaaaagaaaaaggtttattggacttacagttccttgtggctggggaggcgacacagtgatggcagaaggtgaaaggc

SEQ ID NO: 28792 - DNA, 201 bp, Homo sapiens
ggattgatactagctagggtgttgataagaaacagcaggcatagttactgggtgattgagaagagtttaacaaaagactatattagtctgttttcatgctwctgataaaggcatacccaatactaggtcatttacaaaagaaaaaggtttattggacttacagttccttgtggctggggaggcgacacagtgatggcagaa

SEQ ID NO: 28793 - DNA, 201 bp, Homo sapiens
ctttctgttataaaatcatgtttttattgaattacattttaatattggtatcactttaaaatgaaaatgagtacttgcaaaatgtatttttgaaggagttkggtggtggtggggggatgccattttggcaacagatgacttcggttcaagtcctctctctgtctcttacttgctttgtggctttagaccagccacccactc

SEQ ID NO: 28794 - DNA, 201 bp, Homo sapiens
ttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaaatgtatttttgaaggagt

SEQ ID NO: 28795 - DNA, 201 bp, Homo sapiens
ctacaataactttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttttttttttttctttttcccttatgcatttgggagtgga

SEQ ID NO: 28796 - DNA, 201 bp, Homo sapiens
gcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcgggagatta

SEQ ID NO: 28797 - DNA, 201 bp, Homo sapiens
tttttgatttggtttggttctttggagttgtttgcatttcgtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggt

SEQ ID NO: 28798 - DNA, 201 bp, Homo sapiens
cctgcaattctttgtacatatgaaatttaatatggtgagattggcatctagctgctgctagagatagtgctcataataatttttaacattgattgagtgtrgataataatccaggagctgtgctaaacgttttacaacacattatctcacttaatttcacaactccataaagtagttttcacttagttgagggatgaaaaa

SEQ ID NO: 28799 - DNA, 201 bp, Homo sapiens
ctgcctcctgtccctatcattgatacctgcaattctttgtacatatgaaatttaatatggtgagattggcatctagctgctgctagagatagtgctcatartaatttttaacattgattgagtgtggataataatccaggagctgtgctaaacgttttacaacacattatctcacttaatttcacaactccataaagtagt

SEQ ID NO: 28800 - DNA, 201 bp, Homo sapiens
ctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaatgaggtctcatgagcaaattttaaggatggcaaa

SEQ ID NO: 28801 - DNA, 201 bp, Homo sapiens
tgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactc

SEQ ID NO: 28802 - DNA, 201 bp, Homo sapiens
cttaatctcccttttccatgggcccaacacctgaatctagggcaaacaggtgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacctgtgacca

SEQ ID NO: 28803 - DNA, 201 bp, Homo sapiens
tataattttgatgaaagaagtttcccaacagtatttcggtgtgcatgctcacacaccagccctggtcgtcagtgaacagattcttccaggtcttcattgtrgcggaagaaagtgagatcagagatcccgaggaagggcttcagtttcaccagtagtggagctagggagtaggggggcagaagccgcaggaagtcagtgcag

SEQ ID NO: 28804 - DNA, 201 bp, Homo sapiens
tgcttctgacacccagtaagcagctctggcttttataattttgatgaaagaagtttcccaacagtatttcggtgtgcatgctcacacaccagccctggtcrtcagtgaacagattcttccaggtcttcattgtggcggaagaaagtgagatcagagatcccgaggaagggcttcagtttcaccagtagtggagctagggag

SEQ ID NO: 28805 - DNA, 201 bp, Homo sapiens
gattggaacattgtattttatggttgcagagcacacgtatcatcctatctgcttctgacacccagtaagcagctctggcttttataattttgatgaaagargtttcccaacagtatttcggtgtgcatgctcacacaccagccctggtcgtcagtgaacagattcttccaggtcttcattgtggcggaagaaagtgagatc

SEQ ID NO: 28806 - DNA, 201 bp, Homo sapiens
agaaagtataattctttttcttctaactggagatataaaaatcatataagcatgatttatgatttgattggaacattgtattttatggttgcagagcacaygtatcatcctatctgcttctgacacccagtaagcagctctggcttttataattttgatgaaagaagtttcccaacagtatttcggtgtgcatgctcacac

SEQ ID NO: 28807 - DNA, 201 bp, Homo sapiens
gctttaaaaaaaaaaaaaaagggcaaggggaggtgtgagaagaaagtataattctttttcttctaactggagatataaaaatcatataagcatgatttatsatttgattggaacattgtattttatggttgcagagcacacgtatcatcctatctgcttctgacacccagtaagcagctctggcttttataattttgatga

SEQ ID NO: 28808 - DNA, 201 bp, Homo sapiens
aggccctggggtggaaacacactcgatgtgttcaagggagagtaagtggtgaatgggtttggagccaacagggataatagacaacgctatcaagagggggsccaaccacacatgtgcagccactgtatgacgtctggattttccttgacttatggtgatcactattgggaggtggtaagcaaacaggtgacataatttgaa

SEQ ID NO: 28809 - DNA, 201 bp, Homo sapiens
agctggtgacaaaactcaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagatttat

SEQ ID NO: 28810 - DNA, 201 bp, Homo sapiens
gtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacat

SEQ ID NO: 28811 - DNA, 201 bp, Homo sapiens
cattttccccagacctaacctcgatttgtgctccaggtctgagcagaaatgttattccctccagaaagccttccctggatgttgagggatgaagttgtagscccctcccgaatgcgtcctcagaactcgctggttctcgtcctcgccctcagcatacttgctcattgtttgtttccatctctatcatctctgtgagccctt

SEQ ID NO: 28812 - DNA, 201 bp, Homo sapiens
cctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccag

SEQ ID NO: 28813 - DNA, 201 bp, Homo sapiens
atcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtac

SEQ ID NO: 28814 - DNA, 201 bp, Homo sapiens; identical to SEQ ID NO: 8512

SEQ ID NO: 28815 - DNA, 201 bp, Homo sapiens
atttgaaaaaaaaaaaaagtcaccaagttgtttccaattgtttttgtaaatttgcttagtcattttcagagacaaaaatttgggaaaaggattgtagaatsactggcttcccaaaaccacttggtgtttacaaagttatcaaaaacgggctgggaccactgatggtaataacaaaacctggggccctgaatcgtgtattct

SEQ ID NO: 28816 - DNA, 201 bp, Homo sapiens
agtgtgctgaatcatgttttaaacataattatatccggaatgcacttacccatttgaaaaaaaaaaaaagtcaccaagttgtttccaattgtttttgtaartttgcttagtcattttcagagacaaaaatttgggaaaaggattgtagaatgactggcttcccaaaaccacttggtgtttacaaagttatcaaaaacgggc

SEQ ID NO: 28817 - DNA, 201 bp, Homo sapiens
aagtgtgctgaatcatgttttaaacataattatatccggaatgcacttacccatttgaaaaaaaaaaaaagtcaccaagttgtttccaattgtttttgtaratttgcttagtcattttcagagacaaaaatttgggaaaaggattgtagaatgactggcttcccaaaaccacttggtgtttacaaagttatcaaaaacggg

SEQ ID NO: 28818 - DNA, 201 bp, Homo sapiens
attttactcacccagaaggaagccgggtccctctttgcccctttgggtgtttgtgaaaagcaagttgtaaacactgaattctataaactgttggagacagrttctggagagacactcaggcttagctctagaaagaaacgggtaagacagaggaggttcagggcaactgtgttgccttccttgactggtgcatgggaattc

SEQ ID NO: 28819 - DNA, 201 bp, Homo sapiens; identical to SEQ ID NO: 14756

SEQ ID NO: 28820 - DNA, 201 bp, Homo sapiens; identical to SEQ ID NO: 14757

SEQ ID NO: 28821 - DNA, 201 bp, Homo sapiens
tttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcagaccagagttacgtgcacaggttgtaatactctctcttgt

SEQ ID NO: 28822 - DNA, 201 bp, Homo sapiens
gagagagaaaaaaataattcctagatctagagttggtgtgaggctaaaataagctgcttttagtatcacatttggcaagtagtaaactctggataaatatrcttttgaattgtgtgattattgttgttaccatttattgaaagggaatgatgaatgtagtgagagaaggaaggaagagagagagggaagaaggggaaaaag

SEQ ID NO: 28823 - DNA, 201 bp, Homo sapiens; identical to SEQ ID NO: 4976

SEQ ID NO: 28824 - DNA, 201 bp, Homo sapiens
tacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcagattgcctgagctcaggagttgaataccagcctg

SEQ ID NO: 28825 - DNA, 201 bp, Homo sapiens
gcaccactgctcgcattcccatgttggagttttccctttggggttcttatgccattttaaagactctgaaaacaggaagactttttctcttgggtattttwttttttttttcctctgcaagggatggggtcataagacattggtgaggttaggccttcctttgtctcccaggagcacacttgatagcaatgtagggtgaat

SEQ ID NO: 28826 - DNA, 201 bp, Homo sapiens
ttgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgca

SEQ ID NO: 28827 - DNA, 201 bp, Homo sapiens
ggatcttcaggtttggagggaggccgatagagagtgtctggagttgccaacgtcctctccttgggtcatgggtgtgtgtgtgtgtgttttcttcttgttgktgggtttttttttttttttttttttttttttggcttttgcgcctatggtgacttttagcgaatggatactattgaaggaatgtttcacttccaaatccag

SEQ ID NO: 28828 - DNA, 201 bp, Homo sapiens
aatggatcttcaggtttggagggaggccgatagagagtgtctggagttgccaacgtcctctccttgggtcatgggtgtgtgtgtgtgtgttttcttcttgktgttgggtttttttttttttttttttttttttttggcttttgcgcctatggtgacttttagcgaatggatactattgaaggaatgtttcacttccaaatc

SEQ ID NO: 28829 - DNA, 201 bp, Homo sapiens; identical to SEQ ID NO: 8513

SEQ ID NO: 28830 - DNA, 201 bp, Homo sapiens; identical to SEQ ID NO: 14758

SEQ ID NO: 28831 - DNA, 201 bp, Homo sapiens
acaagtcacagggcttatctccattgttctgaacgatctgtagctaaacaaaaagataaaagctattaatattattaatagttgtagattaccgggaagarcgcatcctaaatcagccattagatttgttcctcatttctttgctttacaaattgtttttctgtatagtattggattttcaataaataaagtatgatataa

SEQ ID NO: 28832 - DNA, 201 bp, Homo sapiens
tacgtttttctattttgtctgaactagccaaggtctctggagtttgctgttatattgcttcagagaaattagtgacattgaaaggctgttgtcttttttaktgtacttttggttgttaggagaaatttacaaggccatttttttctcccgtctctgcagttcaggagattatattagaaaatattctatacaaaaaatatg

SEQ ID NO: 28833 - DNA, 201 bp, Homo sapiens
aactctctcattgccttcagagagttggtgattttggggggggcaccagtgtgagtcctttgatccttgaatgacaatttggatttgtctcaaggtcctgmtaaatgggaactggaggaactggcctactatggtattacaggctagcacatggtttgcattctgagggagctcagaataggcaaggtagaagacataggt

SEQ ID NO: 28834 - DNA, 201 bp, Homo sapiens
tatatttcctgtggctgagctgagccgcacttggagatttgatccattttaactctctcattgccttcagagagttggtgattttggggggggcaccagtktgagtcctttgatccttgaatgacaatttggatttgtctcaaggtcctgataaatgggaactggaggaactggcctactatggtattacaggctagcaca

SEQ ID NO: 28835 - DNA, 201 bp, Homo sapiens
gattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtagtttgctgacatccaggctagatccttaat

SEQ ID NO: 28836 - DNA, 201 bp, Homo sapiens
ttcagagaaagtaaagagtgatggagacagagagagaaagtgtgacctactttttattatcagcaccatttcatctgcaaaacacgacttttctcttcttrttacgctgagcatgaaaataaaatgttttccaaaagacctggctttggctgttgtgaggaaggccagggacttgttcaaaactctgatgagctcgatgag

SEQ ID NO: 28837 - DNA, 201 bp, Homo sapiens
tgaggctaaaataagctgcttttagtatcacatttggcaagtagtaaactctggataaatatacttttgaattgtgtgattattgttgttaccatttattraaagggaatgatgaatgtagtgagagaaggaaggaagagagagagggaagaaggggaaaaagagggatggaaaggaggaaggaaggaaaggagggaggag

SEQ ID NO: 28838 - DNA, 201 bp, Homo sapiens
gtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaaacct

SEQ ID NO: 28839 - DNA, 201 bp, Homo sapiens
ggtatttcctggcaacctttggtgtttggggcatgttgtcacctcattgccatctctgcctctgtcttctcaccaccatcttccttgtccatgtctctctrtgtcttcaatgttcttcttataaggacaccagtccttggatttagagcccaccctaattcactgtaatcacatcttacctaagtccatctgcaaagaccc

SEQ ID NO: 28840 - DNA, 201 bp, Homo sapiens
tttatgcatttagagctcccctcttgtgtttcagaaaggaggagttgttgttttcttttcacttgagtttaataaatgaaaaaggggaagggagagggaargaagaggaaaaagcacaaatgtgcttgtttttggatcagcccctgtactgggcacatggatgcagtcagtcctcagtgtaccccaggaaagaggaaactg

SEQ ID NO: 28841 - DNA, 201 bp, Homo sapiens; identical to SEQ ID NO: 8514

SEQ ID NO: 28842 - DNA, 201 bp, Homo sapiens; identical to SEQ ID NO: 8515

SEQ ID NO: 28843 - DNA, 201 bp, Homo sapiens; identical to SEQ ID NO: 14759

SEQ ID NO: 28844 - DNA, 201 bp, Homo sapiens; identical to SEQ ID NO: 14760

SEQ ID NO: 28845 - DNA, 201 bp, Homo sapiens; identical to SEQ ID NO: 14761

SEQ ID NO: 28846 - DNA, 201 bp, Homo sapiens
aaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgtatataaagtcttaacccattgtggaataaattaagt

SEQ ID NO: 28847 - DNA, 201 bp, Homo sapiens
tggaggttgcagtgagccgagatcaggccactgcactccaatctgggtgacagagcaagactctgtctcaaaaataatagtaataataataataataatartaataataataataataataagaatctgactaaggttattaaccattaaggtatgctgtgctaaggagcagggggccccttccatccgtagagggcagaa

SEQ ID NO: 28848 - DNA, 201 bp, Homo sapiens
gttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatct

SEQ ID NO: 28849 - DNA, 201 bp, Homo sapiens
ccacacccggcctcttctcgatagatcttatttggctgacaacgaaagctgttgtgctggtagcatcatccctttgcatgcaaaagataaactgaaatctraagtagccatatccttccggccaggtttttcaagtggttactctgttctgatcattgtcatgacaggaatagtgaaaataacaataaatcatttttcttt

SEQ ID NO: 28850 - DNA, 201 bp, Homo sapiens
cccggactcgaatcccagctctgatccatctcagctctgccatattgccaagttccgctgagactccatttactcacctgttgtatcatctgaattatttycatatccataatgtgcaaggatatccttccatgttattagaaatacagatacaccatcattatcagtggccaaatcattcaaatcgctgtttgcttcttc

SEQ ID NO: 28851 - DNA, 201 bp, Homo sapiens
tgtggactgtagtttgctgacatccaggctagatccttaatatacaatgaagtagtaaaacacatgtaaaagtaaaaagcaggcgaaatagaataaaatasacatttgcacaccacagtatccaaaaaggttatgtactggggctaaagatttggcttggagtttcctggtagtcaaggcaaaaaagggaaacaaaactag

SEQ ID NO: 28852 - DNA, 201 bp, Homo sapiens
atagccttaaagtttctcctgctctttgcagatgaatgaaggggcgctttctggaatctttgtggctggggctgctgctctgcactgctgtggctcttttycacaaatgcttatggagctctaactgggggcaaggaactgtgctacggttgggaagagaggagtgggcaaaaggagacactggggcttctgtgactttag

SEQ ID NO: 28853 - DNA, 201 bp, Homo sapiens
atggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctctttttttttcttttctttc

SEQ ID NO: 28854 - DNA, 201 bp, Homo sapiens
cagtcctcagtgtaccccaggaaagaggaaactgagtctccatgtggctttctgtctggcctttctcttttgcttgccttgtgctttgaatgcaggcctgmtgtttgcctgtggacctcaggatttgtaaggccatctccacccacctacagctaagtttcccaagagccgatctccagccgaagtccaaggttccttgat

SEQ ID NO: 28855 - DNA, 201 bp, Homo sapiens
aggtaagcggctagcacagtgctcagcatgcatgaaggactctttcattatcgttattaactgatgtttttaacttatacattgaaatgtggaaacaagcsttgcttctattgaatgacttcttgaaagtgccagtctgatccttgaccttcaggtgcatctctaaattctttcatgtcagggtctctgaaatctgaacac

SEQ ID NO: 28856 - DNA, 201 bp, Homo sapiens
ctttgatgtgtgtaggtaagcggctagcacagtgctcagcatgcatgaaggactctttcattatcgttattaactgatgtttttaacttatacattgaaakgtggaaacaagccttgcttctattgaatgacttcttgaaagtgccagtctgatccttgaccttcaggtgcatctctaaattctttcatgtcagggtctct

SEQ ID NO: 28857 - DNA, 201 bp, Homo sapiens
tccactgtttatcctggtgaccttaggcaagtcatttaatttccttgagttttggtgtaagtattgatggagcagaccatcaataactgttcttatgtctrttattaccatgtgtctgtctacatgtttgtttgtaaattctctgtgggtaaaagttctcttttcatccccttgcctcagcacggagcccagagccagact

SEQ ID NO: 28858 - DNA, 201 bp, Homo sapiens
accttgtagcaagggggaaaaaaagagcttcttgacatctttttgaagaatggcgctctttaaaaaaacataagggaactttttttttcaaacactgtaaygagggtattcaagtctgcaggcaaaacagagctgtttgaaaagacattagcctcgaaaccgcactgtgccagaatagatacagctacgtcaaaatgccgc

SEQ ID NO: 28859 - DNA, 201 bp, Homo sapiens
ccccccccagcttccccacctgtaaaatgatttgctcaaagtttgcaaagaatggaggcatattcaaagtgctcagcactgggccggacccatgggtatgmattcataatgatcagcttcattctctccctttccctctctctccacacctttccattcctcctaactaatgtgggagagaagagaaaattacagtgagag

SEQ ID NO: 28860 - DNA, 201 bp, Homo sapiens
gtgaggacacatcacttgcacctcagtgtgagtttgaaagtgttttctctggagaataattctgaagaaataggccctccagatatcagtagtgacagggstatcagtaatgttgattactaagttcttgccacaggtagaagccatgctactgcacaagtttcatacttgaagagtggacatctgacacagtgttggtgg

SEQ ID NO: 28861 - DNA, 201 bp, Homo sapiens
attcagaggttgtttttatagcagcaacacagtaagttgggaagagggacacatttttaacatagacaccaaaagagaggctggaagagttgaccacttaraaatgtcacgagtgtctgtgaatagtgttgggggctgagaggcaagagaagaaaatagtcctaatgttgtacaagtagcaatggaaacaaacttgttaaa

SEQ ID NO: 28862 - DNA, 201 bp, Homo sapiens
aggttgtgtctgagattcagaggttgtttttatagcagcaacacagtaagttgggaagagggacacatttttaacatagacaccaaaagagaggctggaaragttgaccacttagaaatgtcacgagtgtctgtgaatagtgttgggggctgagaggcaagagaagaaaatagtcctaatgttgtacaagtagcaatggaa

SEQ ID NO: 28863 - DNA, 201 bp, Homo sapiens
tggaggaggattcaagccccttgcaacggactgaagtgcccaagctctaaatccctgccacccacagcctctgttggccccaggttgtgtctgagattcaraggttgtttttatagcagcaacacagtaagttgggaagagggacacatttttaacatagacaccaaaagagaggctggaagagttgaccacttagaaatg

SEQ ID NO: 28864 - DNA, 201 bp, Homo sapiens
agggggtggaggaggattcaagccccttgcaacggactgaagtgcccaagctctaaatccctgccacccacagcctctgttggccccaggttgtgtctgarattcagaggttgtttttatagcagcaacacagtaagttgggaagagggacacatttttaacatagacaccaaaagagaggctggaagagttgaccactta

SEQ ID NO: 28865 - DNA, 201 bp, Homo sapiens
tggctggaggtacccctcagctcctagaggcatcaacagttcctgaatatctgggcttttcccacaaagcagcttccttcatcaagccagcaacaagagtytctggggcaagttggtcaacaagatggtgtcttacatgcccaatgtaatcatggaagccatgtatacctcatcacatttgccagatttctgctgattaat

SEQ ID NO: 28866 - DNA, 201 bp, Homo sapiens
tgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgaccgtggtgagaatatttacaccatggaaattggcaaatgctactaata

SEQ ID NO: 28867 - DNA, 201 bp, Homo sapiens
ggctgggacaacatgcccactctcaactaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggt

SEQ ID NO: 28868 - DNA, 201 bp, Homo sapiens
ctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggt

SEQ ID NO: 28869 - DNA, 201 bp, Homo sapiens
taatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggattt

SEQ ID NO: 28870 - DNA, 201 bp, Homo sapiens; identical to SEQ ID NO: 4972

SEQ ID NO: 28871 - DNA, 201 bp, Homo sapiens
cttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcac

SEQ ID NO: 28872 - DNA, 201 bp, Homo sapiens
tgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttgg

SEQ ID NO: 28873 - DNA, 201 bp, Homo sapiens
cctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggc

SEQ ID NO: 28874 - DNA, 201 bp, Homo sapiens
tattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgttt

SEQ ID NO: 28875 - DNA, 201 bp, Homo sapiens
aaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctcta

SEQ ID NO: 28876 - DNA, 201 bp, Homo sapiens
tttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttg

SEQ ID NO: 28877 - DNA, 201 bp, Homo sapiens
aaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaat

SEQ ID NO: 28878 - DNA, 201 bp, Homo sapiens
tgtcctgtcgctgtcacaagtttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtt

SEQ ID NO: 28879 - DNA, 201 bp, Homo sapiens
tggaagaaggaaggcgcccctccttcttagctgattgatgatgagatagaaagatagaaacagccccatcactatgagatggaaacccttctttccttcakctgacttccctctccttcattcccaaccaagtttgaccccgccgcagtggagattgtggcagatgggtcagatagcatgtgtcctgtcgctgtcacaagt

SEQ ID NO: 28880 - DNA, 201 bp, Homo sapiens
gtacttcatgatcttggaagaaggaaggcgcccctccttcttagctgattgatgatgagatagaaagatagaaacagccccatcactatgagatggaaacmcttctttccttcagctgacttccctctccttcattcccaaccaagtttgaccccgccgcagtggagattgtggcagatgggtcagatagcatgtgtcctg

SEQ ID NO: 28881 - DNA, 201 bp, Homo sapiens
aagtaaaaccacaggggatctgttggaagtggcatgatggaggaattttaaaagaattgaacaaataaaatagtcagagctcaaaaattgagtactgcttygtttctcccaaataaccatcaccagacaaacaggtgtgtgtgtgggtgggggaggtggcctggtggtacttcatgatcttggaagaaggaaggcgcccct

SEQ ID NO: 28882 - DNA, 201 bp, Homo sapiens
agcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttg

SEQ ID NO: 28883 - DNA, 201 bp, Homo sapiens
tttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccat

SEQ ID NO: 28884 - DNA, 201 bp, Homo sapiens
cctgaggcataaatgggttttaagctccatacagtaaaacctagcatatgaaaacagttctggctgatgggttggtagaagtgatagatatagatacatayatacacatatatgcacagtaatagatataggtaaagaccttgatatatgtacatatattgtatgatacatatccatgcatatacgtgggtgtacacacac

SEQ ID NO: 28885 - DNA, 201 bp, Homo sapiens
taaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtgga

SEQ ID NO: 28886 - DNA, 201 bp, Homo sapiens
ttgaaggaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcg

SEQ ID NO: 28887 - DNA, 201 bp, Homo sapiens
gttttgtttgtaagaatcagttgaggacagatgggactatttgcatggattggtgtcatgtttgaagtcagttaccagagggtttctttcaacagagtatmccaaaaaaaaaaaaaaaaaaaaaaaaaaaaaagtaaattgcacagaccccagcttaggacctggacttaatcttcatgatgtttgtaaagtaatacttct

SEQ ID NO: 28888 - DNA, 201 bp, Homo sapiens
cagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtc

SEQ ID NO: 28889 - DNA, 201 bp, Homo sapiens
caccccttccctcttatcagcttcttgctaccatgcagaaaagtgctgaaggtggcctgccctaaggcagtagcactagagcagggatggggaggacttgstggccagatgcatgtggacatgatggaaagggaagagaagaactgtcaagattttcactatcagtggtataagccccgtagtaatatgcctagtgttcca

SEQ ID NO: 28890 - DNA, 201 bp, Homo sapiens
agtacaagttggtaatgggtaacaggctaaaccatgtggcaccccttccctcttatcagcttcttgctaccatgcagaaaagtgctgaaggtggcctgccytaaggcagtagcactagagcagggatggggaggacttggtggccagatgcatgtggacatgatggaaagggaagagaagaactgtcaagattttcactat

SEQ ID NO: 28891 - DNA, 201 bp, Homo sapiens
cctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtcta

SEQ ID NO: 28892 - DNA, 201 bp, Homo sapiens
ccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacag

SEQ ID NO: 28893 - DNA, 201 bp, Homo sapiens
ggttgtctcgaactcctgagcttaggcagtctgcccacctcagcttcccaaagtgctaggattataggcatgagccaccatgcccggcctaatctaatcarttcctttaaatctgaaactgtccgcctgattctggtttaccacaaccaccagagtcttaagtgtcccaatagccagggtctcatagactctgcttatggt

SEQ ID NO: 28894 - DNA, 201 bp, Homo sapiens
acctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacgg

SEQ ID NO: 28895 - DNA, 201 bp, Homo sapiens
agtggtggcctacttacagtgcatcgcccactctgatttagatgagcaagagctgctgagttgtagatttctagtttctaaacaacaataagtcttgcccscagatagcctcttagcagagccaaaagccagcagagagaagactcagcatttgctttggagtaagtttgtgtgtgtatgtttatctcccttttactcatg

SEQ ID NO: 28896 - DNA, 201 bp, Homo sapiens
ggagtggtggcctacttacagtgcatcgcccactctgatttagatgagcaagagctgctgagttgtagatttctagtttctaaacaacaataagtcttgcycccagatagcctcttagcagagccaaaagccagcagagagaagactcagcatttgctttggagtaagtttgtgtgtgtatgtttatctcccttttactca

SEQ ID NO: 28897 - DNA, 201 bp, Homo sapiens; identical to SEQ ID NO: 4173

SEQ ID NO: 28898 - DNA, 201 bp, Homo sapiens
gggattacctggaaagggtggggcaattttggggggtcaagaaaatgttctaggacaagactgtggtgatggctgcacaactggataaatatactaactawcatcaaactgtatatttacaatggttaaatcatatggtatgtgaatttcacattaataaagtcataaaaaatgaattccaggaccattaaatcaggtgac

SEQ ID NO: 28899 - DNA, 201 bp, Homo sapiens
gtcctacaactggtgagctgtgagctgtaaattgcggaactaatttttatactgccaatctgaggccttttctgacctcatcgctgccactgtaaaatgarttctagccccagaccatgacatgcctactagcttagctctaaccaaaaagatttattatcccaagagttgtgaaaatgtggaagaactagaactgtcatt

SEQ ID NO: 28900 - DNA, 201 bp, Homo sapiens
gctatcgataaaagctaatgtaccacacgaaattggaaggggaacaaaatcacttaagtgttcagggccaccaaggcactggtgcatcccctgtgagcctrtttggctcctggcggtgtttttgttgccctggcttgcaacgtagcctgattgttctaagtaaatggcagagcacgcaaatcaaggacattggcaataaac

SEQ ID NO: 28901 - DNA, 201 bp, Homo sapiens
tttagtgtcacagctcaaaaccatcagtagtcctcgtgatctttcggcattgtggctccctttgtgagaagggcctaagagtgaatctcccaaccataagmtgtattcaggcaggcacgaagtctcttatttactcagtgtttctggagcccagcatagtgcctcgcacacagcaagtgctcagtgggtatctgttgaacc

SEQ ID NO: 28902 - DNA, 201 bp, Homo sapiens
agcaggagataaaaaggcatcagttccattccatatccaagtctgagtccaagggcaggagaagctgatgtctcagcttgaagtcaggcatagagaggcarttctttctcactcagccttttattttattcaggccttcaacagattgtatgaagccacccacactgggaagggcagtctgctttactcatagtactaatc

SEQ ID NO: 28903 - DNA, 201 bp, Homo sapiens
ttgcatactgacctttctgctcttttatgctgcctgctctctaatattgtccaaaaaccttctctaaagaaagtacacaaatggagagagggggaattggrcatgccattgggagaacaaatttatttagatatctttggctgtgttgacagaagctgcccaattatacccaatatacaaattttaaatgcatattagtca

SEQ ID NO: 28904 - DNA, 201 bp, Homo sapiens
cagggatagagtctcaaagttggaggtattttatgttgttttaaataatatcgtcatcacatgtcattttagaccccaaaagtccactccgaatctctgcktatggaattgaggaggggtgaggctgtcagaagccgagggacttggccaaggtcacatggctttggacggcccccctgaaccttggagctcatgttctgt

SEQ ID NO: 28905 - DNA, 201 bp, Homo sapiens
aattagctgcgcgtggtggcgcgtgcctgtagtcctagctactcaagaggctgacatgggaggattgattgagcccaagaggtcaagacggtagtgattcrtggtcacaccactgccctcaaccctgggtgacagggtgagaccctgtctctaaaaacaaaagcaaagtctactaaaaattcactggagctatgagaaatc

SEQ ID NO: 28906 - DNA, 201 bp, Homo sapiens
aaaaattagctgcgcgtggtggcgcgtgcctgtagtcctagctactcaagaggctgacatgggaggattgattgagcccaagaggtcaagacggtagtgaktcgtggtcacaccactgccctcaaccctgggtgacagggtgagaccctgtctctaaaaacaaaagcaaagtctactaaaaattcactggagctatgagaa

SEQ ID NO: 28907 - DNA, 201 bp, Homo sapiens
aagaacattttgtgaatgtttaaatatcctaagacccactaaggaagtttgtggcaatatttgctcaaagacagtatatataataaatactttagactggytaagagaatggctctgaatgtctacctagctatcacatttagaaacgccccttgccttccttccaggactttcttccttaatcaggattgacttaactgt

SEQ ID NO: 28908 - DNA, 201 bp, Homo sapiens
cagcattgggtgtggctctggggattcattctagtgggcaagtctcatatttctcaacctcaggtttttcatctgtaaatggggacaatactgacatctasctaatgtccttgaggatggaatgagatattgagtataaagtatctagtagagtggctagcgtatagtgagtacccaataaatgcaatagatgttggcttt

SEQ ID NO: 28909 - DNA, 201 bp, Homo sapiens
cctggcatactgcaaatatctatggttgataaattaatgttatcatcatcacgtaagcatcttgggaagtctgtaagtaatgggagttggaggcttaacastgatctttgagctggcgatttttccagccaactcattttggacgttggtgcttaagcatatcctgttttcgagggtggtgttggtggtggaggaggtgat

SEQ ID NO: 28910 - DNA, 201 bp, Homo sapiens
ttattagctctgctatcagagtgatgctgtggctggagaagatggagacccatgtgttcaggctgtgagcataggcagatcctttctaatgcagaaggtgyagacacagggcacagaactgccaactgtggctgctgacacctgtctgactttgactgggttagtgacaaagaaatgactttccttttgtatgttagccct

SEQ ID NO: 28911 - DNA, 201 bp, Homo sapiens
catggtgaaagaagacagacagtgtaatttccctggaaactcaattttgattcagacgtccacagcatctcatttctgcctttaaaaaatttcaagagtgrcattttggcatgattggactcacaggtggagaaggtatgacaaacattctggaaatcttggaaggtgaaatatagggaagatggcccctatggaggttca

SEQ ID NO: 28912 - DNA, 201 bp, Homo sapiens
atccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcag

SEQ ID NO: 28913 - DNA, 201 bp, Homo sapiens
tagtatttgccaaaactagaggatgaatgagtgatgggtaagagagttctcagaaaaatggatataaacaatattgtaaatcatatttggaaaataaataytagaatcattgaatccctgagttatagaaaaatttattaatagcgctatctggctactttttaaagtgtggacatcctcgatgtattagctatgcatctg

SEQ ID NO: 28914 - DNA, 201 bp, Homo sapiens
ctttgaaagttgtccttctgcacccattttccccagacctaacctcgatttgtgctccaggtctgagcagaaatgttattccctccagaaagccttccctkgatgttgagggatgaagttgtagccccctcccgaatgcgtcctcagaactcgctggttctcgtcctcgccctcagcatacttgctcattgtttgtttcca

SEQ ID NO: 28915 - DNA, 201 bp, Homo sapiens
gcatgtggcccaccagccatggtttggacaagcttagtctacaggttcttcaagaggggcttgagcatttgaaagacttctagtgggagagatcacaaggkacaagtagaaaatcctgggctggcctgagaggcagacctgtgattattttgctctttgaaagttgtccttctgcacccattttccccagacctaacctcg

SEQ ID NO: 28916 - DNA, 201 bp, Homo sapiens
aaaaaaaatccccaaaaaatctcataatgttttaagaaagtttatgaatttgtgttgggccagattcaaagttgtcctgggccgcatgtggcccaccagcyatggtttggacaagcttagtctacaggttcttcaagaggggcttgagcatttgaaagacttctagtgggagagatcacaaggtacaagtagaaaatcctg

SEQ ID NO: 28917 - DNA, 201 bp, Homo sapiens
atgctttgtaattttttttaaggattgatactagctagggtgttgataagaaacagcaggcatagttactgggtgattgagaagagtttaacaaaagactrtattagtctgttttcatgctactgataaaggcatacccaatactaggtcatttacaaaagaaaaaggtttattggacttacagttccttgtggctgggga

SEQ ID NO: 28918 - DNA, 201 bp, Homo sapiens
gcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaagcagaaaacagaggtctcaatttgccttttcagcgtgaatg

SEQ ID NO: 28919 - DNA, 201 bp, Homo sapiens
tcagtggagggtcagcgtgacagccttttgcacccacatctgggttcttgtccagtgtccaggaggaatgaggtctcatgagcaaattttaaggatggcaratgtgggggattttattgctgatgaaagtggctttcactgggaagataagctaaaaagaagacaaagcaggaaggtaattttcccctggagctatgccat

SEQ ID NO: 28920 - DNA, 201 bp, Homo sapiens
gtgagccctcttactgaattatgtggctggggttcttgggtatgttttgttctattttctggttggtggttttctttctgtcgggtcccgtgggctctttytggacctcttctcagaatgtttttcgttttttttattttttgagatggagtcttgcactgtgtcctgggctggaatgcaatggcaagatccctgctcact

SEQ ID NO: 28921 - DNA, 201 bp, Homo sapiens
ttaacattctttggcagttgtaatttattaattgatttttaaatttggccggtgaaaatgaactttaggtaggggtttgaggaaaatgaaaaggcctattkgtttttcagtggctggttcttcgtgttcagcattaaggattggtagaaatcaggcaacctctatgtaacctcagccatcttggattcccagcttactcac

SEQ ID NO: 28922 - DNA, 201 bp, Homo sapiens
caaagccagcaacagaaactctcttgtgcatggagtcccctcctgctttgaatctctctgactttccttgactttgatgtctaggtctggatttcaagggytcagaaactctctcatgcatgtagttccctcctgctttgaatctctctgactttccttgattttgatgtctaggtctggatttcaagggctcacgtgatg

SEQ ID NO: 28923 - DNA, 201 bp, Homo sapiens
atttatgacttggcttacaatccgttgcagaaagcctagctccccagcttctcctgaatctacgtttttctattttgtctgaactagccaaggtctctggwgtttgctgttatattgcttcagagaaattagtgacattgaaaggctgttgtcttttttagtgtacttttggttgttaggagaaatttacaaggccatttt

SEQ ID NO: 28924 - DNA, 201 bp, Homo sapiens
tcctcctcaagggaaacattcttctcacaatagcttcctggtagaaagttctaactaatgactttaatcgtgtgaatgtattgcagaaatggacaggacarttctcagcccattcatcttacagacctcaagtgaacaggcacaaaacaacaggctccaccctccttcccccctctatctcatactttacctcaatttatg

SEQ ID NO: 28925 - DNA, 201 bp, Homo sapiens
gaaaattcaaaaaattgcaacctgaggcataaatgggttttaagctccatacagtaaaacctagcatatgaaaacagttctggctgatgggttggtagaartgatagatatagatacatatatacacatatatgcacagtaatagatataggtaaagaccttgatatatgtacatatattgtatgatacatatccatgcat

SEQ ID NO: 28926 - DNA, 201 bp, Homo sapiens
tatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaagtgatagatatagatacatatatacacatatatgcacagtaatagatataggtaaagacct

SEQ ID NO: 28927 - DNA, 201 bp, Homo sapiens
gatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtggggtggttggatgggaaggcgggaaagagctagcttggagatgatacgct

SEQ ID NO: 28928 - DNA, 201 bp, Homo sapiens
ctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattgg

SEQ ID NO: 28929 - DNA, 201 bp, Homo sapiens
catgctatctcgacttctgtgtgtctcctttttgtccatctcttaaatcagtcacttggcagcagcaagacatgtggccactccagaccatttgatcgaaragctcttgttaggagattaggctgctaatctgcaagcgagctaatggaaatcattctgggcaaggaaacaaaactgaacaacattagcaaaatcactaca

SEQ ID NO: 28930 - DNA, 201 bp, Homo sapiens
gaccattaatcatgctatctcgacttctgtgtgtctcctttttgtccatctcttaaatcagtcacttggcagcagcaagacatgtggccactccagaccawttgatcgaagagctcttgttaggagattaggctgctaatctgcaagcgagctaatggaaatcattctgggcaaggaaacaaaactgaacaacattagcaa

SEQ ID NO: 28931 - DNA, 201 bp, Homo sapiens
gtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtgg

SEQ ID NO: 28932 - DNA, 201 bp, Homo sapiens
ggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttcgagtcacttgcactca

SEQ ID NO: 28933 - DNA, 201 bp, Homo sapiens
gtgggcttagaagaaaaccagaggtctgtgcacactatggatttttactacaatgatgccctttcacatacagcgagaaggattaagaggtactgtattgktggttgataaagtcaaacttgtgaacagagcaaaagggcattgcttggtcattgcagcttccacccatgcaccttacacagaagtttgggccctaacatg

SEQ ID NO: 28934 - DNA, 201 bp, Homo sapiens
tgtttgtaagaatcagttgaggacagatgggactatttgcatggattggtgtcatgtttgaagtcagttaccagagggtttctttcaacagagtatcccamaaaaaaaaaaaaaaaaaaaaaaaaaaaagtaaattgcacagaccccagcttaggacctggacttaatcttcatgatgtttgtaaagtaatacttcttgga

SEQ ID NO: 28935 - DNA, 201 bp, Homo sapiens
aaactcctgagggatgctcaggaaaccaaaaaggatgtctgcatggaggacaagaaggcacaaatcgtctgatttcaccccatcctaagatcttgtgactycagctttgttttggactggggcattggatctcccacatgccctctcttaagtcgtgcatttgacgcatatttaataagcacctactgtgtgccattagag

SEQ ID NO: 28936 - DNA, 201 bp, Homo sapiens
gtgttaatcttacacctacccattagtctataaaactcctgagggatgctcaggaaaccaaaaaggatgtctgcatggaggacaagaaggcacaaatcgtytgatttcaccccatcctaagatcttgtgacttcagctttgttttggactggggcattggatctcccacatgccctctcttaagtcgtgcatttgacgcat

SEQ ID NO: 28937 - DNA, 201 bp, Homo sapiens
gggagggaagaaccctatgggcagaaatgtgactttctgtagcaaagatgtactgtttcccactgagaagaatcaaaaatagaaaagtgcttccttgtctytctatattgttattaaaacaagtagatgcattttcattgaatcaaggcagttttcctttataaaatgtcctatttcatatcactgttcaaacttgacatc

SEQ ID NO: 28938 - DNA, 201 bp, Homo sapiens
ttacaggatacctagggacctgttggggtgggagggaagaaccctatgggcagaaatgtgactttctgtagcaaagatgtactgtttcccactgagaagawtcaaaaatagaaaagtgcttccttgtctctctatattgttattaaaacaagtagatgcattttcattgaatcaaggcagttttcctttataaaatgtcct

SEQ ID NO: 28939 - DNA, 201 bp, Homo sapiens
tcttacacgttttacgggctatcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggct

SEQ ID NO: 28940 - DNA, 201 bp, Homo sapiens
ctggagtgacagagtgtgtcaagcctgcagctcgtcccgtgtctaatggaacagaaacaagcaccctgctgcccttgttttccagtggctcaccggggctytgcgaggtttattaatcttagcgtataatggaaaatgtgttgccatgtgaaatctagagcctctgttcactactccgcgaattgaaggcggcaggagtct

SEQ ID NO: 28941 - DNA, 201 bp, Homo sapiens
ccagccagggtggtctcgaggaggcccattaccggctggagtgacagagtgtgtcaagcctgcagctcgtcccgtgtctaatggaacagaaacaagcaccytgctgcccttgttttccagtggctcaccggggctctgcgaggtttattaatcttagcgtataatggaaaatgtgttgccatgtgaaatctagagcctctg

SEQ ID NO: 28942 - DNA, 201 bp, Homo sapiens
agtgggagaacatggtatcagaaccaggagagggtcctctggctttctgagttctgccaaaaaccaagttttgctgccttgggcctgtggcttctcctccytgattgtcgctggccttgctgtaaattgtgaggcatccatgtgaggcacaggatggttccaaggaccaactgaggctgtctgtgctgaggctgggagggt

SEQ ID NO: 28943 - DNA, 201 bp, Homo sapiens
gtatagtagtgggagaacatggtatcagaaccaggagagggtcctctggctttctgagttctgccaaaaaccaagttttgctgccttgggcctgtggcttytcctccctgattgtcgctggccttgctgtaaattgtgaggcatccatgtgaggcacaggatggttccaaggaccaactgaggctgtctgtgctgaggctg

SEQ ID NO: 28944 - DNA, 201 bp, Homo sapiens
agtgattcagaaaatagcaagtatagtagtgggagaacatggtatcagaaccaggagagggtcctctggctttctgagttctgccaaaaaccaagttttgytgccttgggcctgtggcttctcctccctgattgtcgctggccttgctgtaaattgtgaggcatccatgtgaggcacaggatggttccaaggaccaactga

SEQ ID NO: 28945 - DNA, 201 bp, Homo sapiens
atgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcacactggggcatagggcttcagcatatgaatttgggggagctggggagaggaacaca

SEQ ID NO: 28946 - DNA, 201 bp, Homo sapiens
cactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcaga

SEQ ID NO: 28947 - DNA, 201 bp, Homo sapiens
atttggaaacacggcacaagcaaaggcttgaaacgtgcttttatgttggtgcttgcccacttgctgtgctacgaacccttttacttctgggtgcgaacaarcccaggctagccttctgggcgatgagagacacaagaccatgtttccatattgccccagccaagagccaacctacagacgcaactgccttgctgacagcag

SEQ ID NO: 28948 - DNA, 201 bp, Homo sapiens
ttgaccaatgaggcatttggaaacacggcacaagcaaaggcttgaaacgtgcttttatgttggtgcttgcccacttgctgtgctacgaacccttttacttytgggtgcgaacaagcccaggctagccttctgggcgatgagagacacaagaccatgtttccatattgccccagccaagagccaacctacagacgcaactgc

SEQ ID NO: 28949 - DNA, 201 bp, Homo sapiens
tagtgatctgattcattaatatcccttgttattaagaactgtctgtatttgtgtcctggttggcagatattaagtccacagataccaataattaatatctwtggttgattgtaaaaatggccaccaattcttccctgtcccctgcatatgtacatccttgcactgtgaaattgtagatctcgccctccaaaggtgaagttc

SEQ ID NO: 28950 - DNA, 201 bp, Homo sapiens
ggtgaaagcatgcaagctaggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttg

SEQ ID NO: 28951 - DNA, 201 bp, Homo sapiens
cttacaagttagattcacactccaggaatgtatctgttcccacatcccctgatgctgagcataccagagttaagggaggcaagcaaggcccctaacctccyaggttcatggaggtacccattctgcacttgttgaccttgagcttgaggactccataaatgtctgcccttggcattgcacgtgcctccctctgggctgacc

SEQ ID NO: 28952 - DNA, 201 bp, Homo sapiens
ttttcgttgcttacaagttagattcacactccaggaatgtatctgttcccacatcccctgatgctgagcataccagagttaagggaggcaagcaaggcccytaacctcccaggttcatggaggtacccattctgcacttgttgaccttgagcttgaggactccataaatgtctgcccttggcattgcacgtgcctccctct

SEQ ID NO: 28953 - DNA, 201 bp, Homo sapiens
gctcagagcccccacccccacccccctttaagtaacagtgacgcaaacgacctttatttagcagaaggtagctctgcgaatccgctgaatgtccgattgckatctcgctggaaagactgctgcttcagcaaggtttctttgctggtctgtggcaaggtccctgcttcattttcaaggtgtcctcacttggtgcctttgaag

SEQ ID NO: 28954 - DNA, 201 bp, Homo sapiens
aaggattattcctccccttttatcaagagccgtaagtccttggaaaatgcaaagagggggaaaaagaagaaaaacagcaacgagtttattggagagttaamacttaaatactccagtacattgagtgtgacatgcctgtgtaggagactgtctgtcccccaaataattgacaatttctctccatctaacaagaaaatatat

SEQ ID NO: 28955 - DNA, 201 bp, Homo sapiens
atcgcagacacggaaaaaaggattattcctccccttttatcaagagccgtaagtccttggaaaatgcaaagagggggaaaaagaagaaaaacagcaacgartttattggagagttaacacttaaatactccagtacattgagtgtgacatgcctgtgtaggagactgtctgtcccccaaataattgacaatttctctccat

SEQ ID NO: 28956 - DNA, 201 bp, Homo sapiens
cttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtcc

SEQ ID NO: 28957 - DNA, 201 bp, Homo sapiens
ctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcg

SEQ ID NO: 28958 - DNA, 201 bp, Homo sapiens
atcatctccgtccacatcaatgtcgtcatcgtccttatgaaaagccctgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaa

SEQ ID NO: 28959 - DNA, 201 bp, Homo sapiens
cgggtggggagggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttagcgctgtcaacatcatctccgtccacatcaa

SEQ ID NO: 28960 - DNA, 201 bp, Homo sapiens
tgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgagaggatgaagt

SEQ ID NO: 28961 - DNA, 201 bp, Homo sapiens
ttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaa

SEQ ID NO: 28962 - DNA, 201 bp, Homo sapiens
gcataatttaggcccctttcaggccactcttccccctgtgccccaggtgtgtttgctaccatacctccccaggggatagccctccaaacctgattggccamctagtctggtcttaaagtcccaaagggaggccatcacaaactactcagtatggagaagacctgaatcctaattttggcttaaccccaaacttgggcgatt

SEQ ID NO: 28963 - DNA, 201 bp, Homo sapiens
cattttactttgcataatttaggcccctttcaggccactcttccccctgtgccccaggtgtgtttgctaccatacctccccaggggatagccctccaaacytgattggccacctagtctggtcttaaagtcccaaagggaggccatcacaaactactcagtatggagaagacctgaatcctaattttggcttaaccccaaa

SEQ ID NO: 28964 - DNA, 201 bp, Homo sapiens
ggtcaaggtagtgttcattaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctacatggaatatttgtgtcttctcccccat

SEQ ID NO: 28965 - DNA, 201 bp, Homo sapiens
gtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatc

SEQ ID NO: 28966 - DNA, 201 bp, Homo sapiens
gagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggactta

SEQ ID NO: 28967 - DNA, 201 bp, Homo sapiens
ttttagacaactggacacaggtttgtctttgaaattgtcctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagataatttta

SEQ ID NO: 28968 - DNA, 201 bp, Homo sapiens
ttgaacccgggaggtggaggttgcagcgagtcaaggtcacgccagtgtactccagcctcggtgacagagcgagactccgtctcaaaaaaaaaaaaaaaaaraaaaagaaaaagaaaaaggtgtttggaagccatgtcccatgaattccaaatacaattgaggactctataaaggactataaaaaaagttgtaataaattat

SEQ ID NO: 28969 - DNA, 201 bp, Homo sapiens
agggattcgtaagcttaggactgatagagatttggcttttctgctgttggattgatagctccttgactgctgaagccattgcccatctgttcaactgttgkattcacgaggaggttagacccctgacccaaggcccaggtacctggctttcctcagttgggatcagaaggccacaaagttttcttatattttaagcatcaa

SEQ ID NO: 28970 - DNA, 201 bp, Homo sapiens
cagagggattcgtaagcttaggactgatagagatttggcttttctgctgttggattgatagctccttgactgctgaagccattgcccatctgttcaactgktgtattcacgaggaggttagacccctgacccaaggcccaggtacctggctttcctcagttgggatcagaaggccacaaagttttcttatattttaagcat

SEQ ID NO: 28971 - DNA, 201 bp, Homo sapiens
ggaatagagaaaaggtggcttggctgtttggtttatgtcctaaaaccttatcgtaatgtgattctccttaacagagggattcgtaagcttaggactgataragatttggcttttctgctgttggattgatagctccttgactgctgaagccattgcccatctgttcaactgttgtattcacgaggaggttagacccctgac

SEQ ID NO: 28972 - DNA, 201 bp, Homo sapiens
ggaaatggaatagagaaaaggtggcttggctgtttggtttatgtcctaaaaccttatcgtaatgtgattctccttaacagagggattcgtaagcttaggamtgatagagatttggcttttctgctgttggattgatagctccttgactgctgaagccattgcccatctgttcaactgttgtattcacgaggaggttagacc

SEQ ID NO: 28973 - DNA, 201 bp, Homo sapiens
attggaaatggaatagagaaaaggtggcttggctgtttggtttatgtcctaaaaccttatcgtaatgtgattctccttaacagagggattcgtaagcttargactgatagagatttggcttttctgctgttggattgatagctccttgactgctgaagccattgcccatctgttcaactgttgtattcacgaggaggttag

SEQ ID NO: 28974 - DNA, 201 bp, Homo sapiens
tttcggatttatattattgcttacttggcacatcttccattggaaatggaatagagaaaaggtggcttggctgtttggtttatgtcctaaaaccttatcgkaatgtgattctccttaacagagggattcgtaagcttaggactgatagagatttggcttttctgctgttggattgatagctccttgactgctgaagccatt

SEQ ID NO: 28975 - DNA, 201 bp, Homo sapiens
tccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagttt

SEQ ID NO: 28976 - DNA, 201 bp, Homo sapiens
tcaagagtctttctcttccttttgagcccagctctccctttgtgacccagcaacttccttccccgatgatggccaagccttgaggatgtgaaactgcccartgccccaatctggagtccaccatcctgggtctagctggggacatccttgaatcagcctctgggaatcactgaaccaacatgagtcacttgctactgtgag

SEQ ID NO: 28977 - DNA, 201 bp, Homo sapiens
ctccttctagaactagaacataagctctctgaagtcagggaccatgcctagaatcgccttccttttatttcccatcagccgaaactaactctgctgtgtcrcgctgtgttaggctgtgttggctgtgagtaagagaagtctcacccaactagctgaagcgaggtgggttggaggggggatgccttgtggaagtgacaactc

SEQ ID NO: 28978 - DNA, 201 bp, Homo sapiens
tttgcctccttctagaactagaacataagctctctgaagtcagggaccatgcctagaatcgccttccttttatttcccatcagccgaaactaactctgctrtgtcacgctgtgttaggctgtgttggctgtgagtaagagaagtctcacccaactagctgaagcgaggtgggttggaggggggatgccttgtggaagtgac

SEQ ID NO: 28979 - DNA, 201 bp, Homo sapiens
caggcagcttctactcatggtggaaagtgaaggggagccagcatgttcagagaacatatagggagaaagggagcaagagaggggaggggaggtgccagagmctttaaaagaaccaactctctgggaacaaatagagggagaacattaatctagccatgagggatccacccccgtaacctagactcctgtcatcagccacgg

SEQ ID NO: 28980 - DNA, 201 bp, Homo sapiens
ttgcattgcatagttaaagttctttaaattcttctctaaaccccaaggctaagcaatatacaatctagttacaatggtctgcttgctgttaccagaatctrtcaagctctttcctatctaagggttttttccatgtactggtttctctcctgcgtggtcttgttctacccttgaggagggtaccacttcctcattgcttag

SEQ ID NO: 28981 - DNA, 201 bp, Homo sapiens
aaatatttattttgagagcaagcacgggggtttatgtgatggctccacagagcagtgaaaagactcccgccctactgctcgcaacctcagatgtccctggscactagcccatctgtatgtctttaaaaaaaataaattaaatttttaaaaacatgactttctggccaggcgcagtggctcatgcctataaccctgcactta

SEQ ID NO: 28982 - DNA, 201 bp, Homo sapiens
aaccatttcacaaatatttattttgagagcaagcacgggggtttatgtgatggctccacagagcagtgaaaagactcccgccctactgctcgcaacctcaratgtccctgggcactagcccatctgtatgtctttaaaaaaaataaattaaatttttaaaaacatgactttctggccaggcgcagtggctcatgcctataa

SEQ ID NO: 28983 - DNA, 201 bp, Homo sapiens
gactcatttaaccatttcacaaatatttattttgagagcaagcacgggggtttatgtgatggctccacagagcagtgaaaagactcccgccctactgctcscaacctcagatgtccctgggcactagcccatctgtatgtctttaaaaaaaataaattaaatttttaaaaacatgactttctggccaggcgcagtggctca

SEQ ID NO: 28984 - DNA, 201 bp, Homo sapiens
ttaaacaattactgtatctgatttttcatttttcattttttttttttctggaagaaagagcagatctggataaagtcagtatacaatgtggtctttggtgmcagacccaagttcaagaccaaggtgtatgcatgggtttgttcaagttgtctacccttattatcccctcagtgaaacatgattaaccatgcttaccttgaa

SEQ ID NO: 28985 - DNA, 201 bp, Homo sapiens
taagactggaatgtgggtgtgtgcactcctcatgttccggtttctgtgatcattcaggcatgcacaggtatcctgatgggtagccaggtcattaggcccaragtcggcagtgtagcatggcaagagaagtcattgcatctccaaactgtgcctaaattgcctgtaatgggttctttgcaacttgcagaaccagatcttacc

SEQ ID NO: 28986 - DNA, 201 bp, Homo sapiens
tgactaagactggaatgtgggtgtgtgcactcctcatgttccggtttctgtgatcattcaggcatgcacaggtatcctgatgggtagccaggtcattaggmccagagtcggcagtgtagcatggcaagagaagtcattgcatctccaaactgtgcctaaattgcctgtaatgggttctttgcaacttgcagaaccagatct

SEQ ID NO: 28987 - DNA, 201 bp, Homo sapiens
tggattggtgattttgactaagactggaatgtgggtgtgtgcactcctcatgttccggtttctgtgatcattcaggcatgcacaggtatcctgatgggtarccaggtcattaggcccagagtcggcagtgtagcatggcaagagaagtcattgcatctccaaactgtgcctaaattgcctgtaatgggttctttgcaactt

SEQ ID NO: 28988 - DNA, 201 bp, Homo sapiens
gtgcttgttaactttgcactctatagccaagtgcgatgatcagaaaatacatacattgaagacaccagaaaatagtgtatggattggtgattttgactaaractggaatgtgggtgtgtgcactcctcatgttccggtttctgtgatcattcaggcatgcacaggtatcctgatgggtagccaggtcattaggcccagagt

SEQ ID NO: 28989 - DNA, 201 bp, Homo sapiens
caggaaggcccttccactgaagctacaactggagctaagcagatggataagccaaaaccacctccgttgctgtggccccatctccaccacaaggaagctgragaagggaccccagaaccggaagacaaaaaacttccttcacacactcccttgctaagaggagaagccccaaagaagctggatatggcccttccctcacat

SEQ ID NO: 28990 - DNA, 201 bp, Homo sapiens
gccactgcactccagcctggatgatagagcgagaccatgtctcaaaataatgataataattgtagtagtagtagtggtggtggtggtggtggtagtagtastagtgaatgccctgactttggggtttgcagtaagctaggattaagtgcttcacagtgaggcacagtggggagctactctgaggatgaattgcctagtaaa

SEQ ID NO: 28991 - DNA, 201 bp, Homo sapiens
tcctcttacagttttggttctttccatgagaaagtatttttaatagcaaagtaatgaacaagaaagtattaataagacccaaataataatataaactactmctttactaatggtcattatgtgccatgccctgctctaaacacttgccatgtagtcactaatttaatcctcacaagaattctgtaatgtagtgtagtttcc

SEQ ID NO: 28992 - DNA, 201 bp, Homo sapiens
gtttctcataacatttgtgtgtgtgtgggtgggtgggtgtgtgtgaaaggtaggatcacctctctgtgcctcagtctccccatcatccttcggtggtagawcaatgctatctgatgaggccttttttgggatcacccactccaacatgcatgtcctttctctgtcccctcctggtgcctgtattagtctgttctcacattg

SEQ ID NO: 28993 - DNA, 201 bp, Homo sapiens
tctttggagaagaggcccacgttcttttcagattctgatttctccgtgatataaatagttttttaggtgatcacttgtttttaatgtacctacctatctawacctttctctctctctctctctctctgtgtgtatgtgtgtgtgtgtataaaattacatatccagtatgaaacctaaaaataagattttggggcctgtgaa

SEQ ID NO: 28994 - DNA, 201 bp, Homo sapiens
tagaaacttggacagaggaaaatgaaaatgttctattaattccactagcatgagataatcactcttaatattttgttgcatgttcttttctttcttctgartgatagcatttttttcaacaaattgggctcgtaatatataggcacatagatatataattaaaaaaacaagaatttctcatgtcattaaacattgcttgaa

SEQ ID NO: 28995 - DNA, 201 bp, Homo sapiens
aaggagaagaaaatgaagaaaaatttagaaacttggacagaggaaaatgaaaatgttctattaattccactagcatgagataatcactcttaatattttgktgcatgttcttttctttcttctgagtgatagcatttttttcaacaaattgggctcgtaatatataggcacatagatatataattaaaaaaacaagaattt

SEQ ID NO: 28996 - DNA, 201 bp, Homo sapiens
aggcatttttctgttgactgtgcatgaagccacatagtaataaacagtttccatatccaagcagctaaggcttgtgccttgcaagttaagtggaacatcasgatctatatctcagttttccttatgtttccccagttggcacatcatggccaacaagagagtagggatcattaaggagtttattttcatctttattttatc

SEQ ID NO: 28997 - DNA, 201 bp, Homo sapiens
ctttttctgactagctgattctgctgctgctggatttattcattcttctccctcacaattttggctcgcacatgcttcctttttagctcatgaccgtgcarttcaactcaacctcatggcatctttttatcagctgtccctgctgcaacaggcttagagttggtttcccaattccctagcgcagaaatccactggcatgag

SEQ ID NO: 28998 - DNA, 201 bp, Homo sapiens
ggcgttctctttttctgactagctgattctgctgctgctggatttattcattcttctccctcacaattttggctcgcacatgcttcctttttagctcatgrccgtgcaattcaactcaacctcatggcatctttttatcagctgtccctgctgcaacaggcttagagttggtttcccaattccctagcgcagaaatccact

SEQ ID NO: 28999 - DNA, 201 bp, Homo sapiens
taactgtctcttgcgatcccctcctgcacaactgtggcgttctctttttctgactagctgattctgctgctgctggatttattcattcttctccctcacarttttggctcgcacatgcttcctttttagctcatgaccgtgcaattcaactcaacctcatggcatctttttatcagctgtccctgctgcaacaggcttaga

SEQ ID NO: 29000 - DNA, 201 bp, Homo sapiens
tggctgacagagggagactctatctcaaaaaaaaataataaaaataataaaaaaaaaattacatgaaaaatagagacaaagtctcgctttgttgcctaggstggtcttgaactcctgggttcacgtgatcctcctgcctcggcttcccaaagtgctgggattacaggcacgagctgccacgcctcacctcttgttttcaat

SEQ ID NO: 29001 - DNA, 201 bp, Homo sapiens
cagggctctgcccattagaatctctagggacagaccgaggtttgagagttcctgctcctgatctcaggggaatcctgaattacaggtgttaacctgattakccccagcccagctcttcgttaattacctgaagtgaatgggacagtttccaatactcagcacaaaggcgtgcgcagtgactctgtggcgtactatctattt

SEQ ID NO: 29002 - DNA, 201 bp, Homo sapiens
ccttagcagacatcatttctctgtttaatctgtctacttgctaattgtctcactgccctccccctccccactggagagtgaatgaaggcttaaggttttgyctgccttggtctctcctgggtcctgagtaccagtggccttacgtggcatttggtagattacatgcttaatgaaaagtgagtgaatgggctgggtgtggtg

SEQ ID NO: 29003 - DNA, 201 bp, Homo sapiens
attcttgcaaatgtttttggtttctctgtctactcattacgtacactctgccagaggttgaaaactcaatgttgagatcacatacatcctgaaaacactgkttaaataaaattttggcctgcatcctgtttttgaaaacttgcaatggcttgccaacgttttcaagttgagaagtttcacaaaaaaaattcggatttccag

SEQ ID NO: 29004 - DNA, 201 bp, Homo sapiens
cagtgtttacagaccccaaagcttgctgtcccctgggcaggtgcatgagggggtcccaggcaatcaggctcttctcaaacctgaattatacccggcctcarggtataggggtcaggcagctgtttgacaggattcttgcaaatgtttttggtttctctgtctactcattacgtacactctgccagaggttgaaaactcaat

SEQ ID NO: 29005 - DNA, 201 bp, Homo sapiens
gtattgttccatttttgagtattactttaatacattattgataagttaatttagaagtatcaagtgaaaggggaagaaaaacagttttgaataaaaacggwgtttcctctggactattttgccaaatgcatttttattggtagaacgtaagcaaatttaaaaaagcaacaaaagcagtttttatgaatacctagcgtactt

SEQ ID NO: 29006 - DNA, 201 bp, Homo sapiens
atttattttgagagcaagcacgggggtttatgtgatggctccacagagcagtgaaaagactcccgccctactgctcgcaacctcagatgtccctgggcacwagcccatctgtatgtctttaaaaaaaataaattaaatttttaaaaacatgactttctggccaggcgcagtggctcatgcctataaccctgcacttagaga

SEQ ID NO: 29007 - DNA, 201 bp, Homo sapiens
aaccatacacatccagtagaaaccgaactttacattttgagtttcgatttttttttttcacctgggctagtaatacgtggtaggatactctctcacaatgytaggccacagcagcgagctgcagctcccagtgatcacaagggcaaagaatcgatattctaccaggcacggtgttgcctgataaccttgcccagctgtagg

SEQ ID NO: 29008 - DNA, 201 bp, Homo sapiens
acatatattgagcattgaccaggtgcccaatattttaatgtcccatgggtgtgcatcaggtacgctgtggaaggacagatgtcattccttaaaggggctgsactgaattagaccaggggttctcaaagtggggtccctggaccggcagcatcaccatcacctggaaacttgttagagatgcagatcttgggccccgcccca

SEQ ID NO: 29009 - DNA, 201 bp, Homo sapiens
ggggtactgataccagagttcatttgaagtcattggaaaccaaggcatattttcttaaagagacaactgtttttggtgaataggccatgttgtttatagtwaaaacaaacatgaatattctgtaatagaagatatcgtttgcatggtgttttaaagctaaaacttgagttattaaacacccttctctccctggggatgcct

SEQ ID NO: 29010 - DNA, 201 bp, Homo sapiens
gggagtgtggttgtacttcaacctggaactgtctaactcctaaggttttattaatatctagtccatttctctcaatctaatagtaaatggaagagaagcamcaacttttgttttccaattccttttgaacatttgaaaggttttctgaaaggacttaaagaaaccatagcttccttaccagttcccaaagcttcagtcctt

SEQ ID NO: 29011 - DNA, 201 bp, Homo sapiens
tatgtctttatcagcagcgtgaaaacggactaatacagtgaggaaatccatgtgttaggaagggagtgtggttgtacttcaacctggaactgtctaactcytaaggttttattaatatctagtccatttctctcaatctaatagtaaatggaagagaagcaacaacttttgttttccaattccttttgaacatttgaaagg

SEQ ID NO: 29012 - DNA, 201 bp, Homo sapiens
ccaggacaggtgccctcctcagcggagacaactgtccccctccatcctgcaggagttttgcagccatccttccagccactgcttctctaccggggcaaatyttcccccaagggataattgataatgtctgaggcatttttaattgtcacaacttggggaaggggcaagggattgagggagagtgctcctggcatctggtgg

SEQ ID NO: 29013 - DNA, 201 bp, Homo sapiens
acctctcctcggccttgcaaagtgctgggattataggtaccccgcctggctgatactttccttagttgttttcagtgtaataacctgtcttcagtctactytttgtccttttctctcctttcctccctgaatactcaagcttccagtgcacagatttctccaaccctgaatgtgactgataccaacaccatactagctctt

SEQ ID NO: 29014 - DNA, 201 bp, Homo sapiens
ttccaagtagctggttttgcaggcatgcaccaccacacccagctagtttttctatttttagtagaggcggagtttcaccaagttggccaggttgttctcaractactgacctctcctcggccttgcaaagtgctgggattataggtaccccgcctggctgatactttccttagttgttttcagtgtaataacctgtcttca

SEQ ID NO: 29015 - DNA, 201 bp, Homo sapiens
gagattcttgtgcctcagccttccaagtagctggttttgcaggcatgcaccaccacacccagctagtttttctatttttagtagaggcggagtttcaccawgttggccaggttgttctcaaactactgacctctcctcggccttgcaaagtgctgggattataggtaccccgcctggctgatactttccttagttgttttc

SEQ ID NO: 29016 - DNA, 201 bp, Homo sapiens
cctcccggattcaagagattcttgtgcctcagccttccaagtagctggttttgcaggcatgcaccaccacacccagctagtttttctatttttagtagagrcggagtttcaccaagttggccaggttgttctcaaactactgacctctcctcggccttgcaaagtgctgggattataggtaccccgcctggctgatacttt

SEQ ID NO: 29017 - DNA, 201 bp, Homo sapiens
tgttttccttaaactctgtgcacatgaatatttgtggtatatggcttaattgtaagcgatcaggcatcaatggctttttatgaggcaaaatctactttctrcatttgcgtgtgccattattatagattgctgatgtttgccaatggatattcttggaagtcgtcttctggtttaaatgcagttaagtatttaaaaataata

SEQ ID NO: 29018 - DNA, 201 bp, Homo sapiens
ctacaagtggagcgtgatttcatctttcatcaagagaagcagcttttcctcctcttgtatccgttttcttccttttctaactatcaaggtcatgcggtatstgccattttgcatattcttgctttgcttcatgttttccttaaactctgtgcacatgaatatttgtggtatatggcttaattgtaagcgatcaggcatcaa

SEQ ID NO: 29019 - DNA, 201 bp, Homo sapiens
ctgtgtcacctcagcatttaatttacttccgtcacaaaactacttgaagttgtcccaggctagttggtcctattaattacaacctagagggattctattartaaactaatggattacagtacctaaatggaagccagcagatgactttggaaggactgatccgcaagggccttctgtgtgaagattaaatgaagcttcctt

SEQ ID NO: 29020 - DNA, 201 bp, Homo sapiens
catgtagaggttggcaaaggggacaggagactgtgggatgattagtatattcttatttggcctgggagggaaaaaaaatctttcatttccaacaatattcwttctctgtgtcacctcagcatttaatttacttccgtcacaaaactacttgaagttgtcccaggctagttggtcctattaattacaacctagagggattct

SEQ ID NO: 29021 - DNA, 201 bp, Homo sapiens
gtgtgtgttgggggtggaattagcatgtagaggttggcaaaggggacaggagactgtgggatgattagtatattcttatttggcctgggagggaaaaaaartctttcatttccaacaatattcattctctgtgtcacctcagcatttaatttacttccgtcacaaaactacttgaagttgtcccaggctagttggtcctat

SEQ ID NO: 29022 - DNA, 201 bp, Homo sapiens
gtcaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatat

SEQ ID NO: 29023 - DNA, 201 bp, Homo sapiens
ctgggcttagtaagttgcctgacttctcatcctggagttcggatccccttgtttctagaagagaaatccctcagatgtgaaggtgtgttccatgattttgycgaacttgccctacatactgttttattatatattctgcccacttctattccctgccaattaattaattgtttcattggtatagttttttttttttttttt

SEQ ID NO: 29024 - DNA, 201 bp, Homo sapiens
acctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttaggaggctgagacaggagaatcacttga

SEQ ID NO: 29025 - DNA, 201 bp, Homo sapiens
acactttgaaataatttatgttatgtgaatttcatctcagcaaaaagaggctaacacataaggagacatattttgatacatgtggcatattaagctgctgytgttgttttttaaatattccagctgcgtgcagtggctcacacctgtaatcccagcactttgggaggctgaggtgggtggatcacttgaggtcaggagttc

SEQ ID NO: 29026 - DNA, 201 bp, Homo sapiens
tttatataaaatatgcagagtaggcaaattcataaagacagaatacgcatcggtggtttctggggcggcggggagtatggaaagcctgttaatgagtacawgtttctttagttttttttggttttttgttttttttttgagacggagtcttgctctgttgcccaggctggagtgcagtggcaccatctctgctcactgcaa

SEQ ID NO: 29027 - DNA, 201 bp, Homo sapiens
aagaggtcacataggatattccatttatataaaatatgcagagtaggcaaattcataaagacagaatacgcatcggtggtttctggggcggcggggagtakggaaagcctgttaatgagtacaagtttctttagttttttttggttttttgttttttttttgagacggagtcttgctctgttgcccaggctggagtgcagt

SEQ ID NO: 29028 - DNA, 201 bp, Homo sapiens
agggagatggagggaggcaaaaagaaaaagggagaaggaaagagaggaaagaggggaagggaggaaggaaagaagagagagaaggaggaagagagggaagkaggcacagaggtagagaggcagggagataatggagatcctggccaaaagttaatgctccgtttctagtagtccacagaaagcaccttgaccaagtgactg

SEQ ID NO: 29029 - DNA, 201 bp, Homo sapiens
ctttccattaagtgagtctttctccaagggaacagaagtcttaggttgttgatctggcggtcagaacctaggacaggcaaggcagtgggctgttgtagagkagatgaagctgatcagagcacacccacaccagtgacaaccggtcaggacctgggaagggctctgacccattcatctgagagatgtggcatgaggaacact

SEQ ID NO: 29030 - DNA, 201 bp, Homo sapiens
ggagttttgtttgcaaatgatcacctggtaatttaagagggtgagctaaacttcctccttttctagtatggacctttggggctcaggatgaggatgttcamtttgtactgctggtggagctgcctttccattaagtgagtctttctccaagggaacagaagtcttaggttgttgatctggcggtcagaacctaggacaggc

SEQ ID NO: 29031 - DNA, 201 bp, Homo sapiens
gggtttatgatcaagtaaagagtttaaagaagtgttttatgagggagttttgtttgcaaatgatcacctggtaatttaagagggtgagctaaacttcctcmttttctagtatggacctttggggctcaggatgaggatgttcaatttgtactgctggtggagctgcctttccattaagtgagtctttctccaagggaacag

SEQ ID NO: 29032 - DNA, 201 bp, Homo sapiens
ttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctccttttctagtatggacctttggggctcaggatgaggatgttcaatttgta

SEQ ID NO: 29033 - DNA, 201 bp, Homo sapiens
ttgttgtaaactcgtcctgccgcctggactagttacgcttcccttgattagctctgagaaacgaggcagcgggcactggggcagccacatagacaacatcyaaatttttgttgctttcctgggtcttgccctgtccttactgtttcccttgggcacgctgttcaccccttaggacatactacagtaaccttttcccaccac

SEQ ID NO: 29034 - DNA, 201 bp, Homo sapiens
tcttaatacaaactggcgtatgttatagttactgtcagttgttgtaaactcgtcctgccgcctggactagttacgcttcccttgattagctctgagaaacraggcagcgggcactggggcagccacatagacaacatctaaatttttgttgctttcctgggtcttgccctgtccttactgtttcccttgggcacgctgttc

SEQ ID NO: 29035 - DNA, 201 bp, Homo sapiens
cccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatga

SEQ ID NO: 29036 - DNA, 201 bp, Homo sapiens
ttctcatgtacttactttaaatcagagagcccacctgtccaattctagcttctcctgggcatcctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaat

SEQ ID NO: 29037 - DNA, 201 bp, Homo sapiens
gatacagatttcactatccatgaattgtggccttaactttctcatgtacttactttaaatcagagagcccacctgtccaattctagcttctcctgggcatyctgtatttgacacagcccctcccagcattctgagtcatcgtctgctgctcttgcactgtccgttttccaaatgaggaactcatcggtaaggccagaaagg

SEQ ID NO: 29038 - DNA, 201 bp, Homo sapiens
tcactgtccaatatggtagccacgtgtgactattaaaatgtaaattaattaaaattaaaagttcaattgctctgaaatagcagccacatttcaaatcttcwgtagccagatgtggttattggctaccatattgggtagcaccgatatagaacatttctaccatagtagaatgctcttttggatacatctgctttaaagcat

SEQ ID NO: 29039 - DNA, 201 bp, Homo sapiens
agagaataaggtgttggtttgttataaggtggtcctttataaagtttagacctattttaataaggctgacttgggttgaagataactagagccatgacttycatcttgatggacaatgagtactcactctacttttttagtttatatttttattttagttcatttcatttaagacagcgtctgttacccaggctggagtgc

SEQ ID NO: 29040 - DNA, 201 bp, Homo sapiens
agtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactga

SEQ ID NO: 29041 - DNA, 201 bp, Homo sapiens
tataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacg

SEQ ID NO: 29042 - DNA, 201 bp, Homo sapiens
caaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttt

SEQ ID NO: 29043 - DNA, 201 bp, Homo sapiens
tgaataccttttgctttctataaaatggtgtggcattgctggtattttcactcttccttcctaccctggatgctgatttgatgcttccagccttagcggtyttcttgcttctaggactgaacagggaagagggaaaagtcaaaagaatgacagaaggtcctcacgttgcagaacactgaccaatgttggcaactacaagac

SEQ ID NO: 29044 - DNA, 201 bp, Homo sapiens
caggcacgccaccacacctggctaatttttgtatttttagtagagatgggggtttcaccatgtgggccaggctggtcttgaactcctgacctcaggtgatygacctacctcggcctcccaaagtgctgggattacagtcatgagtcaccatgcccgaccagcaagaccccactgctattgtccagtgtggtaggtaccttt

SEQ ID NO: 29045 - DNA, 201 bp, Homo sapiens
attgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgaga

SEQ ID NO: 29046 - DNA, 201 bp, Homo sapiens
caaagaattgtagttggatcaaatgagttggagtgggatacagcaacaatctatattctgatttcagcaacactgtgcagtgtaattccatattatattayaccacatcttctgtgggtctttctttgggggaagctaacattttaaaaggtttccctttgtaacctgtaaccccctctaccccaaaagtatattcaagag

SEQ ID NO: 29047 - DNA, 201 bp, Homo sapiens
catgttaattagatatgcatgtatgtgtatgtatgatgtatatacccatatacacacagtctatatatacatgtatgcgcacatacacatattttaaggaragaattataaaatgatcaattcaagcttactatatgctagaggtgaggaatatttgaatacaagtcttatctagtagattaaaacagaaattaaagactg

SEQ ID NO: 29048 - DNA, 201 bp, Homo sapiens
ctggcagagggcttttttctgatcaccacccatgttaattagatatgcatgtatgtgtatgtatgatgtatatacccatatacacacagtctatatatacwtgtatgcgcacatacacatattttaaggaaagaattataaaatgatcaattcaagcttactatatgctagaggtgaggaatatttgaatacaagtcttat

SEQ ID NO: 29049 - DNA, 201 bp, Homo sapiens
tcccctttctggcagagggcttttttctgatcaccacccatgttaattagatatgcatgtatgtgtatgtatgatgtatatacccatatacacacagtctrtatatacatgtatgcgcacatacacatattttaaggaaagaattataaaatgatcaattcaagcttactatatgctagaggtgaggaatatttgaataca

SEQ ID NO: 29050 - DNA, 201 bp, Homo sapiens
aaaattttcccctttctggcagagggcttttttctgatcaccacccatgttaattagatatgcatgtatgtgtatgtatgatgtatatacccatatacacwcagtctatatatacatgtatgcgcacatacacatattttaaggaaagaattataaaatgatcaattcaagcttactatatgctagaggtgaggaatattt

SEQ ID NO: 29051 - DNA, 201 bp, Homo sapiens
aaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaa

SEQ ID NO: 29052 - DNA, 201 bp, Homo sapiens
agattttggaggacttgaaaggttcctgctacctttggctggggatggagggaacatggaagatgggtctttgtttagaggaagctctttatcctggtacsctggaagttggcatagtcttagcagttagtccagatgtgaatttcaggattattctgtgagtcttccaagtcctgtctcagcagtgaaataggctcagtg

SEQ ID NO: 29053 - DNA, 201 bp, Homo sapiens
cttggtaatgtagattttggaggacttgaaaggttcctgctacctttggctggggatggagggaacatggaagatgggtctttgtttagaggaagctcttyatcctggtacgctggaagttggcatagtcttagcagttagtccagatgtgaatttcaggattattctgtgagtcttccaagtcctgtctcagcagtgaaa

SEQ ID NO: 29054 - DNA, 201 bp, Homo sapiens
agaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtt

SEQ ID NO: 29055 - DNA, 201 bp, Homo sapiens
agaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgacctctagccattagataccatctctcccagtagggataataaaaacat

SEQ ID NO: 29056 - DNA, 201 bp, Homo sapiens
ctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccc

SEQ ID NO: 29057 - DNA, 201 bp, Homo sapiens
caaaccctgttttgtagtatttgctgattactgtggtgtaaatactcacaccttggctgatttcaagttgcagcttggaacttggagttagaaagagatgygtagtcccataccattttatgtatgtaaagtatttgcactatgccgactaatagacataaataacctcatgagcatagataatagtcacatctactaaga

SEQ ID NO: 29058 - DNA, 201 bp, Homo sapiens
aatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagtta

SEQ ID NO: 29059 - DNA, 201 bp, Homo sapiens
gttttccgggctgtttgtgtactacacagcctgtgtacctggcaaggcacgctctgctctgccctgccttctgatgagctgactaacaccttatagatgargttcccttagaaccaaagatgccccatgaaactccctaggatgaatgttggaagtccttccaactgggattcccagccggaaaggaaacagttcatctga

SEQ ID NO: 29060 - DNA, 201 bp, Homo sapiens
atcaaggctgggaggaggtctttccactggttttccgggctgtttgtgtactacacagcctgtgtacctggcaaggcacgctctgctctgccctgccttcygatgagctgactaacaccttatagatgaggttcccttagaaccaaagatgccccatgaaactccctaggatgaatgttggaagtccttccaactgggatt

SEQ ID NO: 29061 - DNA, 201 bp, Homo sapiens
ttgtctccatttctgtcccagttacatcaaggctgggaggaggtctttccactggttttccgggctgtttgtgtactacacagcctgtgtacctggcaagrcacgctctgctctgccctgccttctgatgagctgactaacaccttatagatgaggttcccttagaaccaaagatgccccatgaaactccctaggatgaat

SEQ ID NO: 29062 - DNA, 201 bp, Homo sapiens
atggcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgatt

SEQ ID NO: 29063 - DNA, 201 bp, Homo sapiens
ttatactgtgggctgcatcgcttaccaatatttcatctgtttcacttagctgctgttacttactcaataatgtgtggccaatctcacaagatactaattcwttttttcaaatgcagcatcgcttgaagctgtgataaaatatcacacctttggaaatcaaggctcttcttgtttatttatttaactcacattaattagcct

SEQ ID NO: 29064 - DNA, 201 bp, Homo sapiens
cccccttcacatacttatactgtgggctgcatcgcttaccaatatttcatctgtttcacttagctgctgttacttactcaataatgtgtggccaatctcamaagatactaattctttttttcaaatgcagcatcgcttgaagctgtgataaaatatcacacctttggaaatcaaggctcttcttgtttatttatttaactc

SEQ ID NO: 29065 - DNA, 201 bp, Homo sapiens
aaggggtccctagacatgaagggcctcttcaacctaccttttgttggcttcaaggttatgccatattttgcaaagtcaagttggagatggctctcgatatkcatgagtgtgttagactgcttttcttctattttttaaaaatgcacccaaatgtaaaagacacttttacctttttgatttgatgttgaaggtcatttgaaa

SEQ ID NO: 29066 - DNA, 201 bp, Homo sapiens
gacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatca

SEQ ID NO: 29067 - DNA, 201 bp, Homo sapiens
ttttttttattattttttgagacagagtcttgctcttttggccaggctagagtgcagtggcgcgatcttggctcactgcaacctctgtcgattctccttcmtcggcctccgtagtagtcaggactacaggcatgcaccaccatagctggctaatttttgtatttttagttagacaccaggtttcaccatgttagccatgct

SEQ ID NO: 29068 - DNA, 201 bp, Homo sapiens
tgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatac

SEQ ID NO: 29069 - DNA, 201 bp, Homo sapiens
gaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcgcctcccaccaccccttaatttaaagggatttaaaat

SEQ ID NO: 29070 - DNA, 201 bp, Homo sapiens
cacatttcaaatcttcagtagccagatgtggttattggctaccatattgggtagcaccgatatagaacatttctaccatagtagaatgctcttttggatasatctgctttaaagcattagtccccaaagtgtgaaggatgaaccacttgggttccgagaggaaacattataacttctgtttatccattaaactctttcatt

SEQ ID NO: 29071 - DNA, 201 bp, Homo sapiens
cactagggggatggtgattagaaagcacctcatgatcccgtctacttcctgcagagaacagactagccccctatgcagcacacacctttgtgaggtccctyctccaacacagggattacaattcaacctgagacgtgggtggggacacagagccaaaccacactggaaggtaaaaaagttggcaaccagaggcttagagga

SEQ ID NO: 29072 - DNA, 201 bp, Homo sapiens
cttcaagtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacag

SEQ ID NO: 29073 - DNA, 201 bp, Homo sapiens
tagccccctgtacagcacacaactcggggaattttaggtctggtgatttactgctgttggagcctggccttcttcctgggagaaggctggaaaaacttcawgtcagttacttaatggaataatacatgtttcctgcttccattgtcttcctggacctgacactcactctttaaccataagcagaagacacatacaaaaatg

SEQ ID NO: 29074 - DNA, 201 bp, Homo sapiens
cagagaacagactagccccctgtacagcacacaactcggggaattttaggtctggtgatttactgctgttggagcctggccttcttcctgggagaaggctsgaaaaacttcaagtcagttacttaatggaataatacatgtttcctgcttccattgtcttcctggacctgacactcactctttaaccataagcagaagaca

SEQ ID NO: 29075 - DNA, 201 bp, Homo sapiens
accatcccggtaaagtgacgttttgatgaaaacagcatggatcttcctgcagagaacagactagccccctgtacagcacacaactcggggaattttaggtytggtgatttactgctgttggagcctggccttcttcctgggagaaggctggaaaaacttcaagtcagttacttaatggaataatacatgtttcctgcttcc

SEQ ID NO: 29076 - DNA, 201 bp, Homo sapiens
attctcagattcccagccaactggtttcacatgacaagtaaatgagcaacctggaagatgagtggcgtttccacacacagggaagcagatagttccattasgtgacagtgtgtgcacagtttatggaggatgaagcggaaaacctgagccacaaggcagtagaggttggacgagacactcattccgaaggcgggtgtgtat

SEQ ID NO: 29077 - DNA, 201 bp, Homo sapiens
cctgactttctccctggtccaggtgcattttaagcatggaaggtgacacttgccattctcaatggacaaagggagtggggagtgtgggggtgtgctttggrgttagtctctgggttttcgaaacttagcattctcagattcccagccaactggtttcacatgacaagtaaatgagcaacctggaagatgagtggcgtttcc

SEQ ID NO: 29078 - DNA, 201 bp, Homo sapiens
actgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactgg

SEQ ID NO: 29079 - DNA, 201 bp, Homo sapiens
tgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacc

SEQ ID NO: 29080 - DNA, 201 bp, Homo sapiens
cattcttcttaaaatacggagcgacataattaaccctctggggagactaatattagtttattagagacaatttctagttctgtttatttttaacactaaaygatttgttcagattggggaaaaaaattttttttttttttttggttgtggtggcgttggcttttacttggggttgacctttccttatcaaggacatacaag

SEQ ID NO: 29081 - DNA, 201 bp, Homo sapiens
cttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatg

SEQ ID NO: 29082 - DNA, 201 bp, Homo sapiens
ttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgc

SEQ ID NO: 29083 - DNA, 201 bp, Homo sapiens
tatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggc

SEQ ID NO: 29084 - DNA, 201 bp, Homo sapiens
cctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggg

SEQ ID NO: 29085 - DNA, 201 bp, Homo sapiens
gatgggtctttgtttagaggaagctctttatcctggtacgctggaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaat

SEQ ID NO: 29086 - DNA, 201 bp, Homo sapiens
tctcagttaatgcccacaaatttctgaactttgaacataaataccctcactgcaatacatgtttttctttctctctctttctttctttctctttttttttyttttttgaaaaacttttttggagcagcacctgcatgttgtaaaaacacaaaataaaaaaaaaataaataaaagcagaccccttggttcagatatctttgt

SEQ ID NO: 29087 - DNA, 201 bp, Homo sapiens
catgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgtttcactttgctggggtgcaggtgga

SEQ ID NO: 29088 - DNA, 201 bp, Homo sapiens
ttatttgtcttttggcttgtatcccacctgttcactttttaccatagctaacctttctaagtggtcaggtgggactcatggagattttccgttctttggaractagcagcgactgcagattactcatcagctgtctccttgagtccacaatgccgggcggtggacgggcttcctgcctcctggcccagggcccctttgccg

SEQ ID NO: 29089 - DNA, 201 bp, Homo sapiens
cttatttgtcttttggcttgtatcccacctgttcactttttaccatagctaacctttctaagtggtcaggtgggactcatggagattttccgttctttggmgactagcagcgactgcagattactcatcagctgtctccttgagtccacaatgccgggcggtggacgggcttcctgcctcctggcccagggcccctttgcc

SEQ ID NO: 29090 - DNA, 201 bp, Homo sapiens
tcttgctctgttgcccaggctggagtgcagtggcatgatggcatgatcatagttcactataatctcgaactcctggtttcaagtagtcttcctgccttggsctcccaaaatgctaggaatacaggcaggagccactgttactggtctgttttttttccttaaatacataggcaacttcctcgattgtctctcctttattgg

SEQ ID NO: 29091 - DNA, 201 bp, Homo sapiens
ttaaacagagacagatcttgctctgttgcccaggctggagtgcagtggcatgatggcatgatcatagttcactataatctcgaactcctggtttcaagtartcttcctgccttggcctcccaaaatgctaggaatacaggcaggagccactgttactggtctgttttttttccttaaatacataggcaacttcctcgattg

SEQ ID NO: 29092 - DNA, 201 bp, Homo sapiens
gacactggtctgcacaatgagtgtttttgtatatgaaccgaaaaacaggtagcaaaagcaaaaatagacaactgggattacaacaatctaaaaaatttctktacagaaaggaagcaatgaacagagtgaagcagcatcctacagaaagagagagaatatttgcaaaccacacatgtgataagggattaatattcaaaatgt

SEQ ID NO: 29093 - DNA, 201 bp, Homo sapiens
cttctgttaggtgtatctctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtgg

SEQ ID NO: 29094 - DNA, 201 bp, Homo sapiens
cttgtacttcttttaggctatttttccacctggtactatttggctttactgactgccctcattccccatacaccaccttgttttgttcagattcccctaartcttcattctcgtcccacctccccatcactcctgactacttgaaacacgacttctgtcctcagaaggcagcagtgttccctcctcccgttcatttttcat

SEQ ID NO: 29095 - DNA, 201 bp, Homo sapiens
ctgaattatggagttttagttttgctttagaatttttggatgattagacttgtacttcttttaggctatttttccacctggtactatttggctttactgamtgccctcattccccatacaccaccttgttttgttcagattcccctaagtcttcattctcgtcccacctccccatcactcctgactacttgaaacacgact

SEQ ID NO: 29096 - DNA, 201 bp, Homo sapiens
ataaacacatttatagttctcagagattccttgagagaggaacatctttaaatggataaccacagtcttctaaacacctgaaagggtgtcttttgctgaaytatggagttttagttttgctttagaatttttggatgattagacttgtacttcttttaggctatttttccacctggtactatttggctttactgactgccc

SEQ ID NO: 29097 - DNA, 201 bp, Homo sapiens
acatatcagtcattttttgaggaaaataaatttaaggcttggttatcggtccttgagtcagcacattgagcgttttgtcaattagctcctccccccatctktatggtatggcttttcctgtaattacagtcaagatcctatagccggaggaaggcctgtcaattgagtaagaggctgatgttcatcgcacagtgacagccc

SEQ ID NO: 29098 - DNA, 201 bp, Homo sapiens
ggacaacatatcagtcattttttgaggaaaataaatttaaggcttggttatcggtccttgagtcagcacattgagcgttttgtcaattagctcctcccccmatctgtatggtatggcttttcctgtaattacagtcaagatcctatagccggaggaaggcctgtcaattgagtaagaggctgatgttcatcgcacagtgac

SEQ ID NO: 29099 - DNA, 201 bp, Homo sapiens
aggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctccccccatctgtatggtatggcttttcctgtaattacagtcaagatcctatagc

SEQ ID NO: 29100 - DNA, 201 bp, Homo sapiens
tggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctg

SEQ ID NO: 29101 - DNA, 201 bp, Homo sapiens
tgatgtaggaatgaacagatgaacaaccccacacaacctaaggacaactttgaatcaattcttctaagctggtagcagaagccacctttccatttgacttstatctcgctctttttttctttcttttttttttttttggagacagagtctcactctgttgcctagactagagtgcagtggtatgatctcagctcactgcca

SEQ ID NO: 29102 - DNA, 201 bp, Homo sapiens
gtgtgactaatattagaagcagacacagccatgatgagcaatactctttttttgtttatttttgttgttactgctgtaagccactttcttctccctctccrttaaaatgcaacttaattggtaaagtttagttgactagagatttcatttatttatttatttatttatttatttatttatttgtttgtttgtttgtttgag

SEQ ID NO: 29103 - DNA, 201 bp, Homo sapiens
ggtcttctgaagtataggaaaaggcagcttacagaaaaaaacttgcttgtttactgtcttctgagctgatttctcacctactggcaagtggataggtctastttttgtttagctgtttttctaatttaatcttgtacatgagacagctatagatggatgtatagtctttgaagtggggccagttggctccgtctattagct

SEQ ID NO: 29104 - DNA, 201 bp, Homo sapiens
tagtgttggcaaaaggcttgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgag

SEQ ID NO: 29105 - DNA, 201 bp, Homo sapiens
tttttctccttggcaggttttcactattaatttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccga

SEQ ID NO: 29106 - DNA, 201 bp, Homo sapiens
aacaaagagagatcctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttgctct

SEQ ID NO: 29107 - DNA, 201 bp, Homo sapiens
gttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgt

SEQ ID NO: 29108 - DNA, 201 bp, Homo sapiens
atcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtg

SEQ ID NO: 29109 - DNA, 201 bp, Homo sapiens
atagagttgtgtattgttgggaactaattatatgtattataaatccaagaattaatttaaatgacccagtttccacagagaaaaagccacattgtttttamatagctaactaaacaaaatgctaacccatatgggagaaatttccaaagaattaaaaccacccaccaggaaaatgggaaagtctcccctccacacacacac

SEQ ID NO: 29110 - DNA, 201 bp, Homo sapiens
acatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacg

SEQ ID NO: 29111 - DNA, 201 bp, Homo sapiens
agaatacatacttcataagcaggaggcatatatgtttgtatatatgtatgtacatagacttcatacacatgaaataaaatttcaaatggttcctctgttcmgcaaacgtgacccaaagttttggcttatttggcgttttgttttcttgaagacatacttgaattttaaatagttaatccatttaagaagtttcatttaagg

SEQ ID NO: 29112 - DNA, 201 bp, Homo sapiens
gatgttaattgagatataggagtacttcattaagtctccagaatacatacttcataagcaggaggcatatatgtttgtatatatgtatgtacatagacttsatacacatgaaataaaatttcaaatggttcctctgttcagcaaacgtgacccaaagttttggcttatttggcgttttgttttcttgaagacatacttgaa

SEQ ID NO: 29113 - DNA, 201 bp, Homo sapiens
tattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttc

SEQ ID NO: 29114 - DNA, 201 bp, Homo sapiens
cacccaatccgaattttaacaagtcttccatgtgattctgagacagactcatgttcgtgtggttctggctctgcagaactgaggtgggccccaaaacttgmgtttctaaaaggtactagctgagcatgatgactcacatttgtaatcccaccactttgtgaggccgaggcgggtggatcgcttgaggccaggagtttgaga

SEQ ID NO: 29115 - DNA, 201 bp, Homo sapiens
aggtcttgtgtacccaccgatcgcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtaca

SEQ ID NO: 29116 - DNA, 201 bp, Homo sapiens
ttttttgcccttttgggggacaaaatgtctttatgttaaattgttttattattgttatctttatggagttaagggcacataaaatattcttacagagagarattctgtagtttccacaagtaaccagagaattgttcatggcagagaattattttttcaatgcctattttctcctgaattttctgacggagttagagatag

SEQ ID NO: 29117 - DNA, 201 bp, Homo sapiens
tttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttcttcttcatttctaactcatttagtgaattcagttggt

SEQ ID NO: 29118 - DNA, 201 bp, Homo sapiens
ttctttttctttttgtaaaaattgtacagagtttaaagttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttag

SEQ ID NO: 29119 - DNA, 201 bp, Homo sapiens
agaagacagttttttttgtttaaattgttataaataagtaagtgtatgcaccactatgccatgtagcatatcaagattatttttctttcctgcaccttatwttttccctggagttaatactcatctttttttagaaatttgctgagtttgtgatgtacctatcattcaacctcaaactttcatgtgattgtctaaatctca

SEQ ID NO: 29120 - DNA, 201 bp, Homo sapiens
tatcattcaacctcaaactttcatgtgattgtctaaatctcagttccttttattagaaaaaaaaaaaaaaacaactcccctggagcctttgtaccttctgyagtttggggttgttgtcctttttgcttggtgcacaggaatacttggtgatgttctttttaaaactgccctcacattgtatcctggaaagttcatttacct

SEQ ID NO: 29121 - DNA, 201 bp, Homo sapiens
ttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatag

SEQ ID NO: 29122 - DNA, 201 bp, Homo sapiens
ttatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccatt

SEQ ID NO: 29123 - DNA, 201 bp, Homo sapiens
ttctaggcacattaaacggtcagtgcacaggtcctcatttttctcatgcttccatttccatattctcaatcaatcactgatggccagctgtcaacaggcaycatttttggtgggacctgaagatgtatatcccttgttttcagattcctcgcctctcatcatgtaaggtgatgctctgagctgggtcttaaagcttctggg

SEQ ID NO: 29124 - DNA, 201 bp, Homo sapiens
atatgcacccggctagggacctctttaatggtcattcatttgggagatgacctttggttcctaaactggtggacataccaaggactaaaggagtgacttgytctcagttctttgtcattcagctgctttaatattaatatgacacccgttttgggcttgaaaagttttccttctgctgagaaatgatgatggtgacaatga

SEQ ID NO: 29125 - DNA, 201 bp, Homo sapiens
ttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtgggg

SEQ ID NO: 29126 - DNA, 201 bp, Homo sapiens
gtacactgatggtgttttgggaataagagtgtaggtagatagagggtggctagtgattgctaatttttttttttttttttgagttaaaaaagtgctataawattagaatgtagttatggttgtacaattatttgagtatactaaaacagctgtacagtatacataggtagattttatggtatgtgcattatatttcagtaa

SEQ ID NO: 29127 - DNA, 201 bp, Homo sapiens
acgtattgtatggttccatttagtatataaaatgtccggaataggcgaatctataggacagaaagtacactgatggtgttttgggaataagagtgtaggtrgatagagggtggctagtgattgctaatttttttttttttttttgagttaaaaaagtgctataaaattagaatgtagttatggttgtacaattatttgagt

SEQ ID NO: 29128 - DNA, 201 bp, Homo sapiens
gaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaac

SEQ ID NO: 29129 - DNA, 201 bp, Homo sapiens
gggaaatacttacaaattaaatattaaataagggatttgtatctagaataaagaacttttacaattcaataatgaaaactcatttaaaaaatgagcataaratctaaatagatattcctccaaatatgatacacaaattgccaatgaatacataaaagatgttcaatctcattagggaaatgcaaatgaaagccacaatga

SEQ ID NO: 29130 - DNA, 201 bp, Homo sapiens
atgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattatt

SEQ ID NO: 29131 - DNA, 201 bp, Homo sapiens
aggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagt

SEQ ID NO: 29132 - DNA, 201 bp, Homo sapiens
cacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatga

SEQ ID NO: 29133 - DNA, 201 bp, Homo sapiens
ttttgctgttacgagcatggatttagctcatttttaccatcttccctagttgtatcaccttcctcccattatgtttgtaacttcagattttgtatatttcrcatatgtcaatatgtaaacattttatatatatatatatgcatgcacacacatgcatacatatatgtaatggtatatatacatgtaagtttccatttttgc

SEQ ID NO: 29134 - DNA, 201 bp, Homo sapiens; identical to SEQ ID NO: 14762

SEQ ID NO: 29135 - DNA, 201 bp, Homo sapiens; identical to SEQ ID NO: 14763

SEQ ID NO: 29136 - DNA, 201 bp, Homo sapiens; identical to SEQ ID NO: 14764

SEQ ID NO: 29137 - DNA, 201 bp, Homo sapiens; identical to SEQ ID NO: 14765

SEQ ID NO: 29138 - DNA, 201 bp, Homo sapiens; identical to SEQ ID NO: 14766

SEQ ID NO: 29139 - DNA, 201 bp, Homo sapiens; identical to SEQ ID NO: 14767

SEQ ID NO: 29140 - DNA, 201 bp, Homo sapiens
agtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgt

SEQ ID NO: 29141 - DNA, 201 bp, Homo sapiens
gtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattac

SEQ ID NO: 29142 - DNA, 201 bp, Homo sapiens
atatatatatatttatataaatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctc

SEQ ID NO: 29143 - DNA, 201 bp, Homo sapiens
caagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatatatatatatatatata

SEQ ID NO: 29144 - DNA, 201 bp, Homo sapiens
gttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgc

SEQ ID NO: 29145 - DNA, 201 bp, Homo sapiens
cacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcag

SEQ ID NO: 29146 - DNA, 201 bp, Homo sapiens
ctcacatgtaggtcacctacgggagcaggggaggaaccatctgaggtgtttttttttttttttttagatttctcattgctgagaacagttccagctctgcygaccaaaggctgagtgtccttttattagtctgagcccctagagagaccaaagaggcaaccctcgagccaactgacagccagctgtggggttggaccctgt

SEQ ID NO: 29147 - DNA, 201 bp, Homo sapiens
ttgcctgatcgcctctccacccctgctacgtgtaatagaaaggtagggccatgttggagagggatccaacatttattatccccattttacagatgaagaasttaaggtggccaggcatggtggctcatgcctgtaatcctagcactttgggacactgaggtgggtggatcacttgaggtcaggagtttgagagcaatctgg

SEQ ID NO: 29148 - DNA, 201 bp, Homo sapiens; identical to SEQ ID NO: 4971

SEQ ID NO: 29149 - DNA, 201 bp, Homo sapiens
cagtaccctttgctatgccaagatccagctgaaactgaaccaggtgggggaggcctgctaatgcccaggcagtcgaaatgacgccatctcatcactccttytcttaaaatttttttttgtctttcttcttggatttccagcaacagggagctgccaccaccgtgtactgtgctgctgtcccagaactggagggtctgggag

SEQ ID NO: 29150 - DNA, 201 bp, Homo sapiens
gggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttat

SEQ ID NO: 29151 - DNA, 201 bp, Homo sapiens
agcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtc

SEQ ID NO: 29152 - DNA, 201 bp, Homo sapiens
gttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaattt

SEQ ID NO: 29153 - DNA, 201 bp, Homo sapiens
ttttataacggagttgttaacattatttcctttagatggctctttcatcttttctgcattatgaactgatgccccaaaaggtggtatgaatgaaagtcatstgatggtgattaaagtgctctttaaattttttttttaatcagtttaagaatgctttctcttttattggcagtacctgcttgtttactattgagatttcac

SEQ ID NO: 29154 - DNA, 201 bp, Homo sapiens
atttatcacaatggatcagtaagcattgatgacaactggcaaggtattgcttcagatattttataacggagttgttaacattatttcctttagatggctcyttcatcttttctgcattatgaactgatgccccaaaaggtggtatgaatgaaagtcatctgatggtgattaaagtgctctttaaattttttttttaatcag

SEQ ID NO: 29155 - DNA, 201 bp, Homo sapiens
gaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttct

SEQ ID NO: 29156 - DNA, 201 bp, Homo sapiens
actcatgtcttttgtcagggagaatggcatggcctttgtatgacacttccttctagccagactcggatttgggggcatcatatttgggatggctgcaccgyaaacaggaaaggccacaggacagctcacaggttctctctgaacagaagcctgtgagcacgtgcctgtcatttaaaagctgcatggcactcttccccctgc

SEQ ID NO: 29157 - DNA, 201 bp, Homo sapiens; identical to SEQ ID NO: 27121

SEQ ID NO: 29158 - DNA, 201 bp, Homo sapiens; identical to SEQ ID NO: 27122

SEQ ID NO: 29159 - DNA, 201 bp, Homo sapiens; identical to SEQ ID NO: 27123

SEQ ID NO: 29160 - DNA, 201 bp, Homo sapiens
ttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtaga

SEQ ID NO: 29161 - DNA, 201 bp, Homo sapiens
ccttccaagaaccacatgaaggttatattattatgtcgactttccagatgaggagactgaggctcagtggcttgtcataggtgtcaaagacaggagtccartgtaaggacttctggcttcagcacaggggattttcctaccatcccatattgccaccccatctgcaaaaatacctggatctatcttcctcctgctgattct

SEQ ID NO: 29162 - DNA, 201 bp, Homo sapiens
cccaggaaatggccaaatgttatcactcatccttccaagaaccacatgaaggttatattattatgtcgactttccagatgaggagactgaggctcagtggyttgtcataggtgtcaaagacaggagtccaatgtaaggacttctggcttcagcacaggggattttcctaccatcccatattgccaccccatctgcaaaaat

SEQ ID NO: 29163 - DNA, 201 bp, Homo sapiens
tttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcac

SEQ ID NO: 29164 - DNA, 201 bp, Homo sapiens
gagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggccaggggagctacctgagtggagtcaacttttaggttata

SEQ ID NO: 29165 - DNA, 201 bp, Homo sapiens
tgcgtcactgtttttcttatttggagatgctgttcctctcaagtgggaaaaatttggttatctcaggtggtaaagatgcctttgtttaaaatattcttctsttagtggggacaataatactactaatttctagtactgacgcttctcatgcaatttaatcagtaggaacctgtttgcatgttcatttgaggaagtaccaaa

SEQ ID NO: 29166 - DNA, 201 bp, Homo sapiens
tgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttca

SEQ ID NO: 29167 - DNA, 201 bp, Homo sapiens
actgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaaga

SEQ ID NO: 29168 - DNA, 201 bp, Homo sapiens
ttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattttgtttatccatcaac

SEQ ID NO: 29169 - DNA, 201 bp, Homo sapiens
gctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagt

SEQ ID NO: 29170 - DNA, 201 bp, Homo sapiens
ggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaacta

SEQ ID NO: 29171 - DNA, 201 bp, Homo sapiens
caaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaat

SEQ ID NO: 29172 - DNA, 201 bp, Homo sapiens
ctctgagctctaatttcctcacagggccgcaggactgaggttaaggacctgctgtcactggtacagtggttgaagaaaaggtgaatgaaggaagggcctcrttttactccttgtctcacattcctttctgctacttctctttggctcaccaaaaggagacagaagtttgtgtccatggctgtgaactgccaaagagttgcc

SEQ ID NO: 29173 - DNA, 201 bp, Homo sapiens
gaatgggctgtcctctcctgctactttataaaagccaagtttttgcttctagctggtcgaaggtcctgtgggagctcacgtttttctcaatcactgatgaycatttgagacataatttggagaaggtttctatcaaatcctagttggactgcagtgaaatgttttcaaactagagaagcaccaaataggccatgataaaga

SEQ ID NO: 29174 - DNA, 201 bp, Homo sapiens
ctgcacaaagaatgggctgtcctctcctgctactttataaaagccaagtttttgcttctagctggtcgaaggtcctgtgggagctcacgtttttctcaatyactgatgaccatttgagacataatttggagaaggtttctatcaaatcctagttggactgcagtgaaatgttttcaaactagagaagcaccaaataggcca

SEQ ID NO: 29175 - DNA, 201 bp, Homo sapiens
gccttaccccgctacagagaggccccaagagagaggcctcacaccctctggctccactgaaattcacttcacgtttccaacttggattaaactggcacgamagttcagtcaaatgtcaagtccattttgtcaagggagggaactcattcagaagatgaactagttggtgttacttagatgattaactacttggcattaggt

SEQ ID NO: 29176 - DNA, 201 bp, Homo sapiens
ggtatggggtggggaaggggggggggataaagatattaatttggaagcatttgattgctccattattttatcatcttcccatggaaatgttttcataacgygttgttttttaattattattattattttttgagacagagtctcactgagtcgcccagggcggcggtgtgatctcggctcactgcaacctcagtctcccag

SEQ ID NO: 29177 - DNA, 201 bp, Homo sapiens
gagataagaaatggagcaagggaggggtttcatcccgccgtgttcatttgcttggctgtcctgaaattgcgaatacgcagttgttacctgctcccggtggraggggggggatatttatttggcatcttgcaattgataggagctgagtgattttagtaggtagtttaactccttaaaaacttccagtggtttcatattcta

SEQ ID NO: 29178 - DNA, 201 bp, Homo sapiens
aggagagataagaaatggagcaagggaggggtttcatcccgccgtgttcatttgcttggctgtcctgaaattgcgaatacgcagttgttacctgctcccgktgggaggggggggatatttatttggcatcttgcaattgataggagctgagtgattttagtaggtagtttaactccttaaaaacttccagtggtttcatat

SEQ ID NO: 29179 - DNA, 201 bp, Homo sapiens
tttcctcccctgtaaaacgggttaatatcagcacttatcacatagtttttgagaaagctaaacgtgcttatctatagtggttattattactagaaagaatrtcgtggtgcccccaaacatggatttaacaagcattgatcaaatacctcctatgcccctacgaaccaggtactagaaatccactcctttcacttgcttttg

SEQ ID NO: 29180 - DNA, 201 bp, Homo sapiens
gcaacttgggtcatgccactacagatcgacacccactaaatccttttaatttagtctagtgcaacaagtatttgtgtaagtgtcctctgccctggacaccrgtgaggtcaccgtgggaatggctgggcaggaacaaagccttttgtttccagctgagtttccttttctgaagattgcctgtcctagacaccagttctctgt

SEQ ID NO: 29181 - DNA, 201 bp, Homo sapiens
ttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacaccc

SEQ ID NO: 29182 - DNA, 201 bp, Homo sapiens; identical to SEQ ID NO: 14768

SEQ ID NO: 29183 - DNA, 201 bp, Homo sapiens
atcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtg

SEQ ID NO: 29184 - DNA, 201 bp, Homo sapiens; identical to SEQ ID NO: 8516

SEQ ID NO: 29185 - DNA, 201 bp, Homo sapiens
caaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccgccagctgagggagggaattccccttttg

SEQ ID NO: 29186 - DNA, 201 bp, Homo sapiens
acatttgggaaatttgtaaagccttactttgaatgtctttttcttcactctatctgtattgtttggtgctttctatataaatttataaattggatgtaccbccacagatgtcggttttctggtaataatacttttttacattaaaaaaaactcctgaaatgaaaatgtaacttagtcttattattgtaatctccccttgcc

SEQ ID NO: 29187 - DNA, 201 bp, Homo sapiens
ccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgc

SEQ ID NO: 29188 - DNA, 201 bp, Homo sapiens
gaaaaggaacaacaaaaaagtatatctgtgaacttattaaatgactttaatcatatgaaaatcagccatcagccttattagagtggttgattttttttttratctaagagctttcttggttattttctgttcttaatcattgttgtatatccttaatgcgcaggacatgacaccgtataacaagtgttttaaaaatattta

SEQ ID NO: 29189 - DNA, 201 bp, Homo sapiens
aaatcagccatcagccttattagagtggttgattttttttttaatctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaa

SEQ ID NO: 29190 - DNA, 201 bp, Homo sapiens
ccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgcta

SEQ ID NO: 29191 - DNA, 201 bp, Homo sapiens; identical to SEQ ID NO: 4997

SEQ ID NO: 29192 - DNA, 201 bp, Homo sapiens
ttcccagtaggggccggcccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcaggg

SEQ ID NO: 29193 - DNA, 201 bp, Homo sapiens
ctacttccttcttatatctggctatctgggagagaaaaaatttaatacaattgattactttttagaagagttaatttttacttattactgtggattttttkttttttaacagtcacaccgaggagaagactcagtgggaacatccaaaaactggaaaaagaaaacgagtggcaggaggtttgtatgttgttgtctaaggat

SEQ ID NO: 29194 - DNA, 201 bp, Homo sapiens
caccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgtggattttttgt

SEQ ID NO: 29195 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaataggtaggctcttcacttagttatttatctttgggactgctataa

SEQ ID NO: 29196 - DNA, 201 bp, Homo sapiens
ttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 29197 - DNA, 201 bp, Homo sapiens
ctgaaggaaaggattcgatgactatctttttttggcacaaatgtgatccttctggaggccagaagatagattcagtgggccccagttctttcaggtttaakgaataagcattttggtctatgaaaaatggggtttgcctaaagtataagattgtcttatatttataaatgcctgtgttcattgctgtgggttcactgcttt

SEQ ID NO: 29198 - DNA, 201 bp, Homo sapiens
ttagttatttatctttgggactgctataatgagatccacttagatctagctataatggaattttgtttagtggttctctgatttaaacatgacttttatcyttttcagatatcgtttcattaacatcactacctctttttaaatcctaatgttgtcatggaagcctgtgtaggggctgaccttgaagtctctgaaagctga

SEQ ID NO: 29199 - DNA, 201 bp, Homo sapiens; identical to SEQ ID NO: 14769

SEQ ID NO: 29200 - DNA, 201 bp, Homo sapiens
atggattatccttggttgtagtgtttatgtccacatcacatggaatattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 29201 - DNA, 201 bp, Homo sapiens
atggattatccttggttgtagtgtttatgtccacatcacgtggattcccgaaggagcatggattatccttggttgtagtgtttatgtccacatcacatggratattttatttttcaggcctcttcatgtgcttgtgtgcaacgcagcaacttttgctctaccctggagtctcaccaaagatggcctggagaccacctttca

SEQ ID NO: 29202 - DNA, 201 bp, Homo sapiens
catggtgggaatctagaagacggagaaagaatttctcattcccgaaggagcatggattatccttggttgtagtgtttatgtccacatcacgtggattcccraaggagcatggattatccttggttgtagtgtttatgtccacatcacatggaatattttatttttcaggcctcttcatgtgcttgtgtgcaacgcagcaac

SEQ ID NO: 29203 - DNA, 201 bp, Homo sapiens
tcctaataagcctctcatcctcagcaacggaggacagttgcccactcaaagccttgtgacattctagggtatcctatttctacatggtgggaatctagaaracggagaaagaatttctcattcccgaaggagcatggattatccttggttgtagtgtttatgtccacatcacgtggattcccgaaggagcatggattatcc

SEQ ID NO: 29204 - DNA, 201 bp, Homo sapiens
tgctgtcctggttttcacactgaaagttccgtatcctaataagcctctcatcctcagcaacggaggacagttgcccactcaaagccttgtgacattctagrgtatcctatttctacatggtgggaatctagaagacggagaaagaatttctcattcccgaaggagcatggattatccttggttgtagtgtttatgtccaca

SEQ ID NO: 29205 - DNA, 201 bp, Homo sapiens
ccgtgtcattgtggtctcctcagagtcccatcggtgggtttgaattgcatatttgttcacttatcccctttctcataccagctaatattcccccaaggctstcattctgaaaataattttcattagtcctgcttgagacatgtgggtggactcagcttggctcacttaatttttccaggtcttttttgttcgcctgtgatt

SEQ ID NO: 29206 - DNA, 201 bp, Homo sapiens; identical to SEQ ID NO: 4963

SEQ ID NO: 29207 - DNA, 201 bp, Homo sapiens
tcgcagctggtgggtgtacacactgctgtttaccttggcgaggcctttcaccaagtccatggtaagagaacagcttctggcgccgcaaacaccttgggtcytagagaaacctgcacacttgtgtctccacctttttacctcttgcgggcatgagtctggtctcagtaataacattgtccagcccatcataaagggctcttg

SEQ ID NO: 29208 - DNA, 201 bp, Homo sapiens
gctgtttaccttggcgaggcctttcaccaagtccatggtaagagaacagcttctggcgccgcaaacaccttgggtcctagagaaacctgcacacttgtgtstccacctttttacctcttgcgggcatgagtctggtctcagtaataacattgtccagcccatcataaagggctcttgaacacattttcatcaactttaggt

SEQ ID NO: 29209 - DNA, 201 bp, Homo sapiens
tgggaagtcagaacttggttgcttcatgtcatatttcctatttttaagatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 29210 - DNA, 201 bp, Homo sapiens
aaagctgtgtgggaagtcagaacttggttgcttcatgtcatatttcctatttttaagatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 29211 - DNA, 201 bp, Homo sapiens; identical to SEQ ID NO: 4968

SEQ ID NO: 29212 - DNA, 201 bp, Homo sapiens; identical to SEQ ID NO: 14770

SEQ ID NO: 29213 - DNA, 201 bp, Homo sapiens
caataaaaataaaaagctgtgtgggaagtcagaacttggttgcttcatgtcatatttcctatttttaagatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 29214 - DNA, 201 bp, Homo sapiens; identical to SEQ ID NO: 4970

SEQ ID NO: 29215 - DNA, 201 bp, Homo sapiens
cttcttccccctacttccttcttatatctggctatctgggagagaaaaaatttaatacaattgattactttttagaagagttaatttttacttattactgkggattttttgttttttaacagtcacaccgaggagaagactcagtgggaacatccaaaaactggaaaaagaaaacgagtggcaggaggtttgtatgttgtt

SEQ ID NO: 29216 - DNA, 201 bp, Homo sapiens
ctttttacagtcatgtgctttcagcccagtaccctttgctatgccaagatccagctgaaactgaaccaggtgggggaggcctgctaatgcccaggcagtcraaatgacgccatctcatcactccttttcttaaaatttttttttgtctttcttcttggatttccagcaacagggagctgccaccaccgtgtactgtgctgc

SEQ ID NO: 29217 - DNA, 201 bp, Homo sapiens
agctgaaactgaaccaggtgggggaggcctgctaatgcccaggcagtcgaaatgacgccatctcatcactccttttcttaaaatttttttttgtctttctycttggatttccagcaacagggagctgccaccaccgtgtactgtgctgctgtcccagaactggagggtctgggagggatgtacttcaacaactgctgccgc

SEQ ID NO: 29218 - DNA, 201 bp, Homo sapiens; identical to SEQ ID NO: 8517

SEQ ID NO: 29219 - DNA, 201 bp, Homo sapiens; identical to SEQ ID NO: 14771

SEQ ID NO: 29220 - DNA, 201 bp, Homo sapiens; identical to SEQ ID NO: 14772

SEQ ID NO: 29221 - DNA, 201 bp, Homo sapiens; identical to SEQ ID NO: 14773

SEQ ID NO: 29222 - DNA, 201 bp, Homo sapiens; identical to SEQ ID NO: 14774

SEQ ID NO: 29223 - DNA, 201 bp, Homo sapiens; identical to SEQ ID NO: 8518

SEQ ID NO: 29224 - DNA, 201 bp, Homo sapiens; identical to SEQ ID NO: 8519

SEQ ID NO: 29225 - DNA, 201 bp, Homo sapiens; identical to SEQ ID NO: 8520

SEQ ID NO: 29226 - DNA, 201 bp, Homo sapiens; identical to SEQ ID NO: 8521

SEQ ID NO: 29227 - DNA, 201 bp, Homo sapiens; identical to SEQ ID NO: 8522

SEQ ID NO: 29228 - DNA, 201 bp, Homo sapiens; identical to SEQ ID NO: 8523

SEQ ID NO: 29229 - DNA, 201 bp, Homo sapiens; identical to SEQ ID NO: 8524

SEQ ID NO: 29230 - DNA, 201 bp, Homo sapiens
ggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccga

SEQ ID NO: 29231 - DNA, 201 bp, Homo sapiens
gggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagccg

SEQ ID NO: 29232 - DNA, 201 bp, Homo sapiens
ggggcagaggaccataattaaatggctgtggaaacccagaagcagcctacagaaactcttaggagccctccgtctgggaggaattttttttttttttttttttggtatatctgtgtttacagttctagaaaagtgttggttttgagggcaatggagacaggaatgaggagaaaatgtataaaggagaggttgctgtgagcc

SEQ ID NO: 29233 - DNA, 201 bp, Homo sapiens
ggcaggcgaatcgcttgaacccgggaagcagaggttgtagtgagctgagatcatgccactgtactccagcctgggtgacagagcaagactgtctcaaaaargaataaaaatgaataaaaattatgtgattagagaggggaaaacaatcatttcttgtgcgctaatgccactcagcaggtgcttacactgtctggttcatcc

SEQ ID NO: 29234 - DNA, 201 bp, Homo sapiens
ttttttttttttgagacagggccttgctttgtcaccctggctcaagtgcagtggtagaatcatagctcactgcagcctcaaactctttggctccagtgatyctcccacctcaacctcccaagtagctgggactacaggcgtgtaccaccatgaccagctaatcttttagtttttgtagagacaagttcttgctatgttgcc

SEQ ID NO: 29235 - DNA, 201 bp, Homo sapiens
ctttttctttcttttttttttttttgagacagggccttgctttgtcaccctggctcaagtgcagtggtagaatcatagctcactgcagcctcaaactcttkggctccagtgatcctcccacctcaacctcccaagtagctgggactacaggcgtgtaccaccatgaccagctaatcttttagtttttgtagagacaagttc

SEQ ID NO: 29236 - DNA, 201 bp, Homo sapiens
gctggagtgcagtggtgcgatctcagctcactgcagcctctgccccctgggttgaagcgattctcctgcctcagcctcccgagtacctgggactacaggckcccatcaccatgacaggctgattttcttttttttcgtaggacgaggtttcagcatgttcgccaggctggtcttggattcctgatctcacatgattcacca

SEQ ID NO: 29237 - DNA, 201 bp, Homo sapiens
ccttggtctcagggtggttgaccttttgccgatgtgtttttctttcttttcttttcttttcttttgttttcttttcttttctcttctcttcttttcttttytaacagtcttgctctgtcttccaggctggagtgcagtggtgcgatctcagctcactgcagcctctgccccctgggttgaagcgattctcctgcctcagcc

SEQ ID NO: 29238 - DNA, 201 bp, Homo sapiens
tttccacaccctcagcacctccagtttttcctggccttggtctcagggtggttgaccttttgccgatgtgtttttctttcttttcttttcttttcttttgktttcttttcttttctcttctcttcttttcttttctaacagtcttgctctgtcttccaggctggagtgcagtggtgcgatctcagctcactgcagcctctg

SEQ ID NO: 29239 - DNA, 201 bp, Homo sapiens
catttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagcctc

SEQ ID NO: 29240 - DNA, 201 bp, Homo sapiens
tcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagcct

SEQ ID NO: 29241 - DNA, 201 bp, Homo sapiens
atcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagcc

SEQ ID NO: 29242 - DNA, 201 bp, Homo sapiens
aatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagc

SEQ ID NO: 29243 - DNA, 201 bp, Homo sapiens
aaatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcag

SEQ ID NO: 29244 - DNA, 201 bp, Homo sapiens
cttgaagccaagcaaaatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatc

SEQ ID NO: 29245 - DNA, 201 bp, Homo sapiens
tcttgaagccaagcaaaatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgat

SEQ ID NO: 29246 - DNA, 201 bp, Homo sapiens
ttgataatgctgatgtgactggacttttgacaagcagtctgggacttctgctgaaaagtgctcttgaagccaagcaaaatcatttccacaccctcagcacytccagtttttcctggccttggtctcagggtggttgaccttttgccgatgtgtttttctttcttttcttttcttttcttttgttttcttttcttttctctt

SEQ ID NO: 29247 - DNA, 201 bp, Homo sapiens
ccaagcccagagttcatttaagtggcagcgatgggaccaaattataggccaggtctgtcttatgaaagatgataaatggatgtgtcatatcgggaaagaartcactctgtcatcatatgacaggctggcttgatttctttgcaccagtgtccctaaaagttgggatgggggtgtgaagcgtgccagctttcaaagccagtt

SEQ ID NO: 29248 - DNA, 201 bp, Homo sapiens
tgtttaatttataatttttgtttttatcattaaaagcaacagattgctgtattcttgcctgccactgacatggacttaattgtttcatttagacatttaartgggcaatacacttaaaatgcagatataactttaattgtcaaaacatgcttattttaggaaatgtgtttctccagtaaagctcagtatctggggcttttt

SEQ ID NO: 29249 - DNA, 201 bp, Homo sapiens
actaaaatgccagcatcactgttacttactgtgtttctctggatgtattacttaacctctctggctttatttctgcccgccctccccccgccccccccccscaatgcctcaatctgtggcagagttgttacattattgaaaaagaacataaagcatattttctggcatacagcatatgtttaatttataatttttgttttt

SEQ ID NO: 29250 - DNA, 201 bp, Homo sapiens
tattctgtctttttatattctgccacccctatcatacttatgaaaatgccaggttgtaatcattcactgggagaaacaaggggttgaacattgttatcgcrcaaaggaagctgggcctagtaaaggaatgtaaatactaaaatgccagcatcactgttacttactgtgtttctctggatgtattacttaacctctctggct

SEQ ID NO: 29251 - DNA, 201 bp, Homo sapiens
ggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcag

SEQ ID NO: 29252 - DNA, 201 bp, Homo sapiens
gtttacatgaggggctgctgcttgtgttgtacattctataggtttgttcaatgcataatgacaggtgtctgtcatttcattatggagtgaaaccattccartttcatacagcgtagtttcacgcctctaaaagtcccctgaaagtgttattaaaagtactatctggccatgtcctcatttccccagcaaagtccttctgag

SEQ ID NO: 29253 - DNA, 201 bp, Homo sapiens
atttaaggtactgttaaaaagaaaaaacacagaacaacacagtgagagcagaaaaggtatcatctcctccccctcttcttctcttttagaaaccttgctgcgtgatccactgatggtaaatatttcatgtactttgcatatcagcctgagttccttttgtgaagtcaggtaaatggaatgtaaatcccctcgtcctccaga

SEQ ID NO: 29254 - DNA, 201 bp, Homo sapiens
catttaaggtactgttaaaaagaaaaaacacagaacaacacagtgagagcagaaaaggtatcatctcctccccctcttcttctcttttagaaaccttgctgcgtgatccactgatggtaaatatttcatgtactttgcatatcagcctgagttccttttgtgaagtcaggtaaatggaatgtaaatcccctcgtcctccag

SEQ ID NO: 29255 - DNA, 201 bp, Homo sapiens
tcatttaaggtactgttaaaaagaaaaaacacagaacaacacagtgagagcagaaaaggtatcatctcctccccctcttcttctcttttagaaaccttgctgcgtgatccactgatggtaaatatttcatgtactttgcatatcagcctgagttccttttgtgaagtcaggtaaatggaatgtaaatcccctcgtcctcca

SEQ ID NO: 29256 - DNA, 201 bp, Homo sapiens
gcctgccttggcctgccaaagtgctgggattacagacatgagccaccaaacctggtcaattttctatggtgtgtgttacattttttaaaattttattttamtgtttatatagaaaaagttgccttatcaaccattataatcatggtatttagtgagtgtaatctgttctgatgtaatacttagtttaactggtaaaaaata

SEQ ID NO: 29257 - DNA, 201 bp, Homo sapiens
tgcagtggtgtgatctcggcacactgcaaccttcgcctcccaggttcaggcgattctcctgcctcagcctcctgggtagctgggactacgggagcatactmccacacccaggtaatttttcatttttggtagagacggcgtttcaccgtgttggccaggcttgtctcaacccctgagctcaggtgatccgcctgccttggc

SEQ ID NO: 29258 - DNA, 201 bp, Homo sapiens
caggcctggagtgcagtggtgtgatctcggcacactgcaaccttcgcctcccaggttcaggcgattctcctgcctcagcctcctgggtagctgggactacrggagcatactaccacacccaggtaatttttcatttttggtagagacggcgtttcaccgtgttggccaggcttgtctcaacccctgagctcaggtgatccg

SEQ ID NO: 29259 - DNA, 201 bp, Homo sapiens
ttcaaattattcccccctttacagacacagaaactaagatttagagaggttatgcaatgtgccaacagggagaagttggagctggaatttgaaccaggctrgctgactccaaagctgtgtcctcaagcagtacatcagagccgaggaaggtcaagtttggaacgccatttagctgctctcagggagtctgattactgtttc

SEQ ID NO: 29260 - DNA, 201 bp, Homo sapiens
ttccttctactttggtgccccatgatgatgtgcatcttttttatttctgcatcatatccatatagtgatatcatgtataatgatgtttaagaagacagttwtttttgtttaaattgttataaataagtaagtgtatgcaccactatgccatgtagcatatcaagattatttttctttcctgcaccttattttttccctgga

SEQ ID NO: 29261 - DNA, 201 bp, Homo sapiens
aaggtaatattggcatatttatttttatctgtgtaatttttgcaacttataaccccttcaggtccaaatgaaacaggcaaccaggtaataaaccaattacrttctaatacagattacttcatgacagtgtcttattttccagtttatatgtaggtgagattctttggagaccgtcttcgtaatatagctagtttttgtcca

SEQ ID NO: 29262 - DNA, 201 bp, Homo sapiens
aatatgttcgattgaggtttgtgtctgtaatttggaacggctttttgttgcaactaaaatattcatttgcagaaattatcactgagggtgttagcttcttyatgcttgcgtttcttgcatttgttactaaataaaatatttagaagtcacgtcgattttcaaaatgatagttaaggatgaaggtaatattggcatatttat

SEQ ID NO: 29263 - DNA, 201 bp, Homo sapiens
tgagactacaggcgcatgccaccaccgccagctaatttttgtatttttagtggagacgaggtttcaccgtgttggccgggatgctctcgatcttttgaccwcgtgatccgcccgccttggcctcccatagtgctgggattataggcgtgaaccaccgtgcccggcagggagtaacatttctatgcaactatatgtgggtgt

SEQ ID NO: 29264 - DNA, 201 bp, Homo sapiens
cctcagcctcccgagtaggtgagactacaggcgcatgccaccaccgccagctaatttttgtatttttagtggagacgaggtttcaccgtgttggccgggaygctctcgatcttttgaccacgtgatccgcccgccttggcctcccatagtgctgggattataggcgtgaaccaccgtgcccggcagggagtaacatttcta

SEQ ID NO: 29265 - DNA, 201 bp, Homo sapiens
atgtcctaaattaatgtgtttaaagagaaaatttcaccagtggtaattttttttttttttcccctgagaaagtcttgctctgttgccaggctatagtgcastggcgtgatctcagctcactacaatctctgcctcctgggttcaagcaattctcctgcctcagcctcccgagtaggtgagactacaggcgcatgccaccac

SEQ ID NO: 29266 - DNA, 201 bp, Homo sapiens
atattttaccacaaattaaagaaaattaatatttccaacaagccaaagctctatgtaaatgtcctaaattaatgtgtttaaagagaaaatttcaccagtgrtaattttttttttttttcccctgagaaagtcttgctctgttgccaggctatagtgcactggcgtgatctcagctcactacaatctctgcctcctgggttc

SEQ ID NO: 29267 - DNA, 201 bp, Homo sapiens
cctcccaaagtactggattacaggcatgagtcactgcctggtgctttctttttgtctttttctaataaccattgctatagatggttgtccttaacgcgtawatgtttaaaatacctaaatgcctaaacgtttgaaaacattccttaaaaattgaagttatagcatactaacaagtgttcatttttataattgctgatttaa

SEQ ID NO: 29268 - DNA, 201 bp, Homo sapiens
ttacagtcgtgtgccaccacgcctggttagtttttgtatttttagtagagatgggtttcactgtgttggctaaggtggtctcaaactcatgacctcaagtkatccgcccgcttcagcctcccaaagtgctgggattacaggcgtcagccactgtgcccggccggatagaaataatttttataaactccttggatgctacct

SEQ ID NO: 29269 - DNA, 201 bp, Homo sapiens
taatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttag

SEQ ID NO: 29270 - DNA, 201 bp, Homo sapiens
ataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgcctta

SEQ ID NO: 29271 - DNA, 201 bp, Homo sapiens
atgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattccc

SEQ ID NO: 29272 - DNA, 201 bp, Homo sapiens
aggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgatt

SEQ ID NO: 29273 - DNA, 201 bp, Homo sapiens
gtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcg

SEQ ID NO: 29274 - DNA, 201 bp, Homo sapiens
tgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagc

SEQ ID NO: 29275 - DNA, 201 bp, Homo sapiens
ttttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttca

SEQ ID NO: 29276 - DNA, 201 bp, Homo sapiens
gattttgtgaggatgatgatataatttccattacattacagcatataaatataaatatatatatatatatatatatatatatatatatatatatatatatwtatattttattatttttttttgagacggagtcttgctctgtcaccaggctggagtgcagtggtgcaatctcggctcactgtaacctccgccgcccgggtt

SEQ ID NO: 29277 - DNA, 201 bp, Homo sapiens
tgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggt

SEQ ID NO: 29278 - DNA, 201 bp, Homo sapiens
ttgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccggg

SEQ ID NO: 29279 - DNA, 201 bp, Homo sapiens
attgattttgtgaggatgatgatataatttccattacattacagcatataaatataaatatatatatatatatatatatatatatatatatatatatatawatatatattttattatttttttttgagacggagtcttgctctgtcaccaggctggagtgcagtggtgcaatctcggctcactgtaacctccgccgcccgg

SEQ ID NO: 29280 - DNA, 201 bp, Homo sapiens
accaattttaagaaatcctttataggactatttgtgaaattgattttgtgaggatgatgatataatttccattacattacagcatataaatataaatatawatatatatatatatatatatatatatatatatatatatatatatattttattatttttttttgagacggagtcttgctctgtcaccaggctggagtgcag

SEQ ID NO: 29281 - DNA, 201 bp, Homo sapiens
tccactctgggtaactgttttggattattttctctattccaactgaaataaaaaaaaattaattaaatgtggctaggttatcttgacagcagaatccattsccagttaattattattttaatacttgatggtgtctgtcaaattgtcgacatgtgacggtcctttcaaatttaaaggaatagctgatggtcactggccacc

SEQ ID NO: 29282 - DNA, 201 bp, Homo sapiens
attattgttggtgttaaataatgattatgtaaagcactagactagacattcgtcggcaaagtttttctgcaaagaatcagatagtaaatatttttgctctyatcagccagacagtctctgcggcaaccattcaagcattgttgaatacattgttgagtgttacatgagactattgtaatataaaagtagcctgggacaaca

SEQ ID NO: 29283 - DNA, 201 bp, Homo sapiens
ttccattttctttgacatgactatgtctgttcctcttgattttaggcatctttttcagatgagttgccataaaagcagcctgctctggataagtgaggtayagcaggacacactgcaaatactaggaatccttaagtacagtggaaccccagagcactctacctgctttctttctcacctccttaaaaactttttttgccc

SEQ ID NO: 29284 - DNA, 201 bp, Homo sapiens
ttttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaa

SEQ ID NO: 29285 - DNA, 201 bp, Homo sapiens
tgtcaccggtataatttaaagaaattatacttaagctttgtctcacttagaagataatatagaacagtggtgtttttttaattaaaaaaaaagttaaaatracggttttgtatccttgctttacttcttaaacatatgggaggaaaaaaaatctttaacaagtttatttattttcattttctgctaaattactttcagaac

SEQ ID NO: 29286 - DNA, 201 bp, Homo sapiens
tgaactttctgtcaccggtataatttaaagaaattatacttaagctttgtctcacttagaagataatatagaacagtggtgtttttttaattaaaaaaaargttaaaataacggttttgtatccttgctttacttcttaaacatatgggaggaaaaaaaatctttaacaagtttatttattttcattttctgctaaattac

SEQ ID NO: 29287 - DNA, 201 bp, Homo sapiens
gattgtctagttctaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccacttgc

SEQ ID NO: 29288 - DNA, 201 bp, Homo sapiens
ggattgtctagttctaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccacttg

SEQ ID NO: 29289 - DNA, 201 bp, Homo sapiens
gggattgtctagttctaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccactt

SEQ ID NO: 29290 - DNA, 201 bp, Homo sapiens
aggtcctccccctgtcagatcagcaacagcattagtctcataggaccgtgatccctattgtgagccacacatgcaagggatctaggctgcatgctccttasgaaaatctaatgcctgatgatctgtcactgcctcccatcaccttcaagatgggattgtctagttctaggaaaacaagctcagggctcccaccgattgtac

SEQ ID NO: 29291 - DNA, 201 bp, Homo sapiens
cccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagaga

SEQ ID NO: 29292 - DNA, 201 bp, Homo sapiens
acccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagag

SEQ ID NO: 29293 - DNA, 201 bp, Homo sapiens
cacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacaga

SEQ ID NO: 29294 - DNA, 201 bp, Homo sapiens
tccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttct

SEQ ID NO: 29295 - DNA, 201 bp, Homo sapiens
aaaaaaatcagccccttaaaatgctgactagtaacatcagtttttggaaggatactatttttgtttccattctgtctttatagtttgaacttttccttttsatagtctgtaaatattcatcatctcagagccttttgaattgcaatggcttttagtcaaaactgagcgcaatgtgccatttgaataataagaacctcatta

SEQ ID NO: 29296 - DNA, 201 bp, Homo sapiens
aaaacttagcagttgtaagttacttacagagaagactgggctagttggctgtgctatcatttttgttgaaatactgctttggggtcgccatctgggaatgytcttcctgttttatgggggaaatacatacatgcgtttttataatatgtagcctgcatatcccttggggtttccactgggggcttggctgagcagagcaat

SEQ ID NO: 29297 - DNA, 201 bp, Homo sapiens
aagttaacaaccagaagatcacgagctaaaccaataaagtgaattatggtcagttgcagattcactgccagacctgggaggaaatctcaccttggcagatsgagtctcttgtcctcgcctaacaatcagcagttcacctctcgaaaaggggttccgtttgcaatctgtcagccactaccttcttatttagagcatgtccca

SEQ ID NO: 29298 - DNA, 201 bp, Homo sapiens
gctggatgatgggtatagggtgttctctgtaccagtttggccatgttttgtgaatctataattagtttcaaataaaagttaacaaccagaagatcacgagstaaaccaataaagtgaattatggtcagttgcagattcactgccagacctgggaggaaatctcaccttggcagatcgagtctcttgtcctcgcctaacaat

SEQ ID NO: 29299 - DNA, 201 bp, Homo sapiens
agtgtgagcaagtcataattctgggttattctaattaatggagatttgggggttgttccttactgaagcacatcctgattgatgcagaggatcttgtgagycatgctaaggaattcagcccacgtcttactgaccactctgacgtactaaagggttggttttgccaatgaagagagcaggctctgactgaacgaggcctga

SEQ ID NO: 29300 - DNA, 201 bp, Homo sapiens
ggaagaatgaggatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagca

SEQ ID NO: 29301 - DNA, 201 bp, Homo sapiens
gggtgagagacatcagcataatgcaattaaggcccattggattagaatttgcaggatgccattagcaataagctctgagtgtagattattgccgtgcttamattttctccttcagcggtaacacttctcttgtaaattctaactgggtaaaataaatatgatataaaacagacacaaataagaatatatagatgatgttaa

SEQ ID NO: 29302 - DNA, 201 bp, Homo sapiens
ttcatttctgcttgcacactggacaatgctttttttcaggaacacatctctttcttgtaatatctttgtaaaagcagcgtggagcagccagcacacaatgmcattttagctcttccctagagcttcagactcaataggtactagatctaccttatgagttatggcagagcacaattttaccaaaagtctttcagtgtaaag

SEQ ID NO: 29303 - DNA, 201 bp, Homo sapiens
attgactttttcaactctgtaatgtcctaactttcatttctgcttgcacactggacaatgctttttttcaggaacacatctctttcttgtaatatctttgyaaaagcagcgtggagcagccagcacacaatgccattttagctcttccctagagcttcagactcaataggtactagatctaccttatgagttatggcagag

SEQ ID NO: 29304 - DNA, 201 bp, Homo sapiens
cctccatggtcccatctgaactggatctagagaagggttactctccttagggaaattagcagctgtcagcccacttcctgctggtgcatggttgaggctcygtttttttgtttttagcagttataggcttttaaggtcagattaatctttatttaatttcttaataatcttataggattcagatgtatttgtttcccatta

SEQ ID NO: 29305 - DNA, 201 bp, Homo sapiens
atccaggtctgaaatctgctctctggagggaagtgccctgtccattatcctccatggtcccatctgaactggatctagagaagggttactctccttagggraattagcagctgtcagcccacttcctgctggtgcatggttgaggctccgtttttttgtttttagcagttataggcttttaaggtcagattaatctttatt

SEQ ID NO: 29306 - DNA, 201 bp, Homo sapiens
gtctgtgtgcgactgtcagctgctctctactgctcctcatagacttcctgtctgcctttttctgcatttctcagtctccccatctccccttcttatctaayccccttccttcctctctcaactcttccttcctctatcctttttctttcccttttttttttaactattcttctttagagtttgttttctcattgaacttgt

SEQ ID NO: 29307 - DNA, 201 bp, Homo sapiens
atgtagtaaggcctcttttcaatgtggtaaaagctctgggccaccccataaggctgcaagcgctagaagctcttcccatagagaacatctatatcctcaamccaaggagaaaaaggaagctgctgttcataaatattgaagaggcagggagagcttgcactgaggccagggtgtattaacatgcatgccatcgtgaagtgg

SEQ ID NO: 29308 - DNA, 201 bp, Homo sapiens
actcagttttcaaactggcttaatccaaagcctggggggtggatgtaggagagaagttgaaattagctggggttttttttttgtatcacaaaagttacattttttttttttttttttttttttaagacgtagtcttgctctgttgcccaggctggagtgcagtggtgtgatttcggctcacagcaagctctgcctcccagg

SEQ ID NO: 29309 - DNA, 201 bp, Homo sapiens
gactcagttttcaaactggcttaatccaaagcctggggggtggatgtaggagagaagttgaaattagctggggttttttttttgtatcacaaaagttacattttttttttttttttttttttttaagacgtagtcttgctctgttgcccaggctggagtgcagtggtgtgatttcggctcacagcaagctctgcctcccag

SEQ ID NO: 29310 - DNA, 201 bp, Homo sapiens
ccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcacctcctctatggctccccccaccaaatttctgtgtcttcatttgcaactctcttttctcc

SEQ ID NO: 29311 - DNA, 201 bp, Homo sapiens
taaaaatacaaaaattatctgggtgtggtggcacatgcctgtaatcccagctactcaggaagctgaggactgagaatcgcttgaacctgggaagtggagtwtgcagtgagccgagatagttctactgcactccagcctgagcaacagagcaagactccgtgtcaaaaaataaataatatatgtgtgtgtgtgtgtatgtac

SEQ ID NO: 29312 - DNA, 201 bp, Homo sapiens
ctttgggaggctgaggtgggcagatcacttgaggtcaggagtttgagaccagcctggccaacatggtgaaaccctgtctctactaaaaatacaaaaattakctgggtgtggtggcacatgcctgtaatcccagctactcaggaagctgaggactgagaatcgcttgaacctgggaagtggagtatgcagtgagccgagata

SEQ ID NO: 29313 - DNA, 201 bp, Homo sapiens
tctcatatcgaaggataacctcttgtatttacaaaaaaaagaagaaaaagtgctgtcatcagtaaattcattcatgtatgttatacacttacatacaaaaygtatctatttgattaaattagaactctgctaatgaattactttccttgattgcacagtaataaagtcaatgttgtaaatataataattatagccaagtgc

SEQ ID NO: 29314 - DNA, 201 bp, Homo sapiens
taatcaacaattctcatatcgaaggataacctcttgtatttacaaaaaaaagaagaaaaagtgctgtcatcagtaaattcattcatgtatgttatacactyacatacaaaatgtatctatttgattaaattagaactctgctaatgaattactttccttgattgcacagtaataaagtcaatgttgtaaatataataatta

SEQ ID NO: 29315 - DNA, 201 bp, Homo sapiens
gtaaaagcatcatgcaccaggtaaaatgtttaataacacagagaaatctaattgtcaagtatcttctcaacacacattaatcaacaattctcatatcgaargataacctcttgtatttacaaaaaaaagaagaaaaagtgctgtcatcagtaaattcattcatgtatgttatacacttacatacaaaatgtatctatttga

SEQ ID NO: 29316 - DNA, 201 bp, Homo sapiens
gttctctggatggtggtgtcatgccaacatgggagccactagcacaaagaacatgctaggttctgttgagacctgactttgggaatagcataggtacttayctttctcagcaccacacaaacacactccagaatgcaaaggaacctgcactgtgccatcttgcttctccctgcatagccacttctctttccagtggtgttt

SEQ ID NO: 29317 - DNA, 201 bp, Homo sapiens
ggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtataccttt

SEQ ID NO: 29318 - DNA, 201 bp, Homo sapiens
tggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctt

SEQ ID NO: 29319 - DNA, 201 bp, Homo sapiens
ctggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacct

SEQ ID NO: 29320 - DNA, 201 bp, Homo sapiens
tctggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacc

SEQ ID NO: 29321 - DNA, 201 bp, Homo sapiens
tttttttcctaaaaaaaaaaaaaaaaaaaaaagaagaatcgcttgaacccgggaggtggagcagtgagccaaggtcatgccactgcactccagcttgggcracagagcgagactctgtctcaaaataaataaataaaaatgcatatatgtatatttgtgtgaatcatatacacatatataaaatatatgtatcatatacat

SEQ ID NO: 29322 - DNA, 201 bp, Homo sapiens
aagctaaatggtattttcgtttttctcaagctcttccaataaatatgaccaccaagatttttttttcctaaaaaaaaaaaaaaaaaaaaaagaagaatcgmttgaacccgggaggtggagcagtgagccaaggtcatgccactgcactccagcttgggcaacagagcgagactctgtctcaaaataaataaataaaaatgc

SEQ ID NO: 29323 - DNA, 201 bp, Homo sapiens
acaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaataa

SEQ ID NO: 29324 - DNA, 201 bp, Homo sapiens
cacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaata

SEQ ID NO: 29325 - DNA, 201 bp, Homo sapiens
tcacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaat

SEQ ID NO: 29326 - DNA, 201 bp, Homo sapiens
caacaaaacagaatattccagtgttctttctccggggagatggcattttcctggttgcccctccactgagagttggctgaaacaaagaatttgtcctgtayggaaaacaggagactttgtacagtggcctctctaaaggtgcaagatattcaaaagagaaacccgcatacatttggatattaagaaataattctggggatt

SEQ ID NO: 29327 - DNA, 201 bp, Homo sapiens
tgaatcaacaaaacagaatattccagtgttctttctccggggagatggcattttcctggttgcccctccactgagagttggctgaaacaaagaatttgtcmtgtatggaaaacaggagactttgtacagtggcctctctaaaggtgcaagatattcaaaagagaaacccgcatacatttggatattaagaaataattctgg

SEQ ID NO: 29328 - DNA, 201 bp, Homo sapiens
gaggttcctgtctgccagtcactctatagtaactattaggaaacccctttttttctctgaagtcattgctcctgtgtgtgtgtgtctgtatataaaaaaaagtatgtatacatatacgtatatgtatgtgtatagataaaaatgcatgtatggtgctgggcgcagtggctcacgcctgtaatcccagcactttgggaggct

SEQ ID NO: 29329 - DNA, 201 bp, Homo sapiens
gagaggatagtataatgaggttcctgtctgccagtcactctatagtaactattaggaaacccctttttttctctgaagtcattgctcctgtgtgtgtgtgkctgtatataaaaaaaagtatgtatacatatacgtatatgtatgtgtatagataaaaatgcatgtatggtgctgggcgcagtggctcacgcctgtaatccc

SEQ ID NO: 29330 - DNA, 201 bp, Homo sapiens
acttagaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaag

SEQ ID NO: 29331 - DNA, 201 bp, Homo sapiens
ggtatcacagaagccaagacaggaaagtgagccagaagtgagggaggagcaggatcctctgcaacagggcagtctagtcttagcagagaggaggttgctgratttattgattgagaagccactcctcgccaggcagttttgagaggttctggatggtgatagaatggaattcattcagctgatgatgagaagtagatttgg

SEQ ID NO: 29332 - DNA, 201 bp, Homo sapiens
gtgcataatgcttccaggtacacttgtctacacatttttgtgtggatataggttttccttttttggggtatgctcctaagagtgcaatttctggatcacgkggaactccttgtttaaccttttgaggagccaccagattgttctccacagcagccacacccatctacattctaaccagcagtgtaggaaggttccgatttc

SEQ ID NO: 29333 - DNA, 201 bp, Homo sapiens
catatactgatgcggtgtttattttattttagttttttgagacagggtctctgtcgctcaggctggattgagtgcagtgaatcttggctcactgtagcttytgcctcttgagctcaggcaatcctcctgcctcagccccaccagtagctgggactagaggcacatgccactacacccagttaattactacattttctgtag

SEQ ID NO: 29334 - DNA, 201 bp, Homo sapiens
gaaaaagatcatagagccaaagagctcgatacatatactgatgcggtgtttattttattttagttttttgagacagggtctctgtcgctcaggctggattragtgcagtgaatcttggctcactgtagcttctgcctcttgagctcaggcaatcctcctgcctcagccccaccagtagctgggactagaggcacatgccac

SEQ ID NO: 29335 - DNA, 201 bp, Homo sapiens
gtaatgtcacttatatccaggaaagagtggcaaagaaccatcccagcagatagcttgagggtgggaagggggataggttgttgataatatggaataggagraaaaagatcatagagccaaagagctcgatacatatactgatgcggtgtttattttattttagttttttgagacagggtctctgtcgctcaggctggattg

SEQ ID NO: 29336 - DNA, 201 bp, Homo sapiens
ctaattatctccttcccccgccccctccattctctttccatcctttaaatgtcagtgtcccccacaattctgttgttgaccctttctccctctggccaatrctccttcccctgtagatcatacccattcccaagatttcagtcatcaaatccattccaatatgactcctgtatccatatgtccagttccaagtatctgtcc

SEQ ID NO: 29337 - DNA, 201 bp, Homo sapiens
tatgagtgaatggcagcgttttgacaggatgatgaataaatatgctgggcccagaggactccaggtgataagcatttctttgtggtctggtaagtgatagyacccattgcttaatttctctaaaatctgcatttgtcaattttgtatttttttatttgaaaggtatttgcttaaataaataggccatataaatctagctcc

SEQ ID NO: 29338 - DNA, 201 bp, Homo sapiens
ttttgtcagttcatctatctgtccatctctttgtccatccatccaactacccacttacccatccatccatacatttatccatccatctacccacccatccrtccatccatccatccatgcatccatccatccatccatcatccatccatgcatgtaagttgcagacatcaacaaactttacccttaaggactttggctggc

SEQ ID NO: 29339 - DNA, 201 bp, Homo sapiens
actcaacagttgctaatgttttgccatgttttgtcagttcatctatctgtccatctctttgtccatccatccaactacccacttacccatccatccatacrtttatccatccatctacccacccatccatccatccatccatccatgcatccatccatccatccatcatccatccatgcatgtaagttgcagacatcaaca

SEQ ID NO: 29340 - DNA, 201 bp, Homo sapiens
agtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttctg

SEQ ID NO: 29341 - DNA, 201 bp, Homo sapiens
cagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttct

SEQ ID NO: 29342 - DNA, 201 bp, Homo sapiens
gcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttc

SEQ ID NO: 29343 - DNA, 201 bp, Homo sapiens
tgcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaactt

SEQ ID NO: 29344 - DNA, 201 bp, Homo sapiens
gaggttgcagtgagccgatgtcatatcactgcactctagcctgggcgacagagtgagactctgtctcagaaaaaaaaaaaaaaaaaaaaaaaaaaaaaaaaggctttcctgaaaggtgattcacaggcctcttcggatcccttcgtgtttagcaatttggatttccacacagccttgctgtgccttctgcccatttgtcct

SEQ ID NO: 29345 - DNA, 201 bp, Homo sapiens
ataaaatacaatgaatccacaaacagcttcttcttcattatgtaccccatacctattagaccatcataaaatataactatatgagtatcatagaaaagtttaaagctgtctctactctgttatgctaagatatattagtttcataaccactcaatatattcatagttaatttatcctttattttaaaaaaatgtcctgcag

SEQ ID NO: 29346 - DNA, 201 bp, Homo sapiens
gcagactcttcatactcaaagcagtaaaaaataaaataaaataaaatacaatgaatccacaaacagcttcttcttcattatgtaccccatacctattagascatcataaaatataactatatgagtatcatagaaaagtttaaagctgtctctactctgttatgctaagatatattagtttcataaccactcaatatattc

SEQ ID NO: 29347 - DNA, 201 bp, Homo sapiens
gtagtatatttgggcagactcttcatactcaaagcagtaaaaaataaaataaaataaaatacaatgaatccacaaacagcttcttcttcattatgtacccyatacctattagaccatcataaaatataactatatgagtatcatagaaaagtttaaagctgtctctactctgttatgctaagatatattagtttcataacc

SEQ ID NO: 29348 - DNA, 201 bp, Homo sapiens
taggtaaggacagtggtaccattctgacggactctcggatgcttggttttatggagggatcttaaaacagtaatcggcccatatgtgcagcaacctttgcrcctaaatagctgaggacaaagtaggttgcttacttcaagagcccttccctttctcttctttgtcaggcctgtaatgttcctcacccactgagtatttaat

SEQ ID NO: 29349 - DNA, 201 bp, Homo sapiens; identical to SEQ ID NO: 8525

SEQ ID NO: 29350 - DNA, 201 bp, Homo sapiens; identical to SEQ ID NO: 8526

SEQ ID NO: 29351 - DNA, 201 bp, Homo sapiens; identical to SEQ ID NO: 8527

SEQ ID NO: 29352 - DNA, 201 bp, Homo sapiens; identical to SEQ ID NO: 8528

SEQ ID NO: 29353 - DNA, 201 bp, Homo sapiens; identical to SEQ ID NO: 8529

SEQ ID NO: 29354 - DNA, 201 bp, Homo sapiens; identical to SEQ ID NO: 8530

SEQ ID NO: 29355 - DNA, 201 bp, Homo sapiens; identical to SEQ ID NO: 8531

SEQ ID NO: 29356 - DNA, 201 bp, Homo sapiens; identical to SEQ ID NO: 8532

SEQ ID NO: 29357 - DNA, 201 bp, Homo sapiens; identical to SEQ ID NO: 8533

SEQ ID NO: 29358 - DNA, 201 bp, Homo sapiens; identical to SEQ ID NO: 8534

SEQ ID NO: 29359 - DNA, 201 bp, Homo sapiens; identical to SEQ ID NO: 8535

SEQ ID NO: 29360 - DNA, 201 bp, Homo sapiens
agcaccatgccattcacacttcagaaccaagctcagatccatgtgtgacactctggaatgtggcagctgatggaggaagggggctgaagttgaatctgcastagttgagttaaccttcccatggtgcctgcactagcagggactggactgagaccccagctttcccagtcaggccttcatttttctctcatggtgagagct

SEQ ID NO: 29361 - DNA, 201 bp, Homo sapiens
tgggcttgcttccacttgtggccaggagaggatatttcttactccagatcaaagagttgagacattgccttcccacaattcccagtgagcccaactccttrccacaattcccaccccatgccttccccaaattcctgatgagccctatgccttcccacaattccctgtaaattttgctccttcccacaaccccagtgagcc

SEQ ID NO: 29362 - DNA, 201 bp, Homo sapiens
tttcaccatgttggtcaggctggtcttgaacttctgacctcgtgatttgcctgcctcagcctcccaaagtgctgagattacaggcgtgagccgccatgccygcccttatttttatatatcttccataacctttctatctctttctttctctttctctgtttctgtgtgtgtctgtgtctgataataaaatacattaaattt

SEQ ID NO: 29363 - DNA, 201 bp, Homo sapiens; identical to SEQ ID NO: 8536

SEQ ID NO: 29364 - DNA, 201 bp, Homo sapiens
ttcatgggatctggatgaattaatgtgttatgtgtttgtgctaagtatgaatgtatggtgaggagtgtgtgtgtgtgtgtgtgtgtgtgtgtgtgtgtgtgcattaaatgttttaacacaacattgccaacccttcccctagcagcaccgtgggcaaagcataaagggatgatctggcagcagccccacttgggttttcta

SEQ ID NO: 29365 - DNA, 201 bp, Homo sapiens
tttcatgggatctggatgaattaatgtgttatgtgtttgtgctaagtatgaatgtatggtgaggagtgtgtgtgtgtgtgtgtgtgtgtgtgtgtgtgtgtgcattaaatgttttaacacaacattgccaacccttcccctagcagcaccgtgggcaaagcataaagggatgatctggcagcagccccacttgggttttct

SEQ ID NO: 29366 - DNA, 201 bp, Homo sapiens
gccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtat

SEQ ID NO: 29367 - DNA, 201 bp, Homo sapiens
tgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggta

SEQ ID NO: 29368 - DNA, 201 bp, Homo sapiens; identical to SEQ ID NO: 27124

SEQ ID NO: 29369 - DNA, 201 bp, Homo sapiens; identical to SEQ ID NO: 4911

SEQ ID NO: 29370 - DNA, 201 bp, Homo sapiens
gctcagttacttttttcctgtttttttttcacttttgtcttcctgacttttttcttccatccctatttatgaaaacaaaaagataactaaattgaaaccttgacaatgtaatttgtcagaggaaggcagcctgttttataagctcaggtgatttcatttttgttcacctgtttatttcatgacacttgcaggaaaaagaag

SEQ ID NO: 29371 - DNA, 201 bp, Homo sapiens
gtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaaccttgacaatgtaatttgtcagaggaaggcag

SEQ ID NO: 29372 - DNA, 201 bp, Homo sapiens
gcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtga

SEQ ID NO: 29373 - DNA, 201 bp, Homo sapiens
atgtaagtgtagctccaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctcta

SEQ ID NO: 29374 - DNA, 201 bp, Homo sapiens
caatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaa

SEQ ID NO: 29375 - DNA, 201 bp, Homo sapiens
acaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaa

SEQ ID NO: 29376 - DNA, 201 bp, Homo sapiens
cacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaaca

SEQ ID NO: 29377 - DNA, 201 bp, Homo sapiens
tccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaa

SEQ ID NO: 29378 - DNA, 201 bp, Homo sapiens
ttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtga

SEQ ID NO: 29379 - DNA, 201 bp, Homo sapiens
tttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtg

SEQ ID NO: 29380 - DNA, 201 bp, Homo sapiens
catttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtg

SEQ ID NO: 29381 - DNA, 201 bp, Homo sapiens
tcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgt

SEQ ID NO: 29382 - DNA, 201 bp, Homo sapiens
gagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatg

SEQ ID NO: 29383 - DNA, 201 bp, Homo sapiens
tgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagat

SEQ ID NO: 29384 - DNA, 201 bp, Homo sapiens
gtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggaga

SEQ ID NO: 29385 - DNA, 201 bp, Homo sapiens
ctgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactgggga

SEQ ID NO: 29386 - DNA, 201 bp, Homo sapiens
caagtttctgtgtggacatgttctcacttttcttgggtatatacttaggggtggaattgctgggtcatatgatcagtctaggtttaactttttgatgaacwgacaaactgctatccacagtggctgcctgtaccattttacagaaaatctctgcttttaatacttctggatgtgttctaaggcactaggcttttcattaag

SEQ ID NO: 29387 - DNA, 201 bp, Homo sapiens
acccttgtatccttgttttgtttcgtttccctgcaaacattgttttagttgagatgaaattcacgtaatatacagttaaccattttaaagtgtacacttcrgtggcatttagtgaactcagtgttatgccaccgtcacctctttttagtttcaaaactttgtcatcaccccagaaaagcatacacataaagtcatcactgc

SEQ ID NO: 29388 - DNA, 201 bp, Homo sapiens
gattacacccaccaccatgcccggctagtttttgtatttttagtagagatggggtttcaccatgttggccaggctggtctcaaactcgtgacctcaagcartccacccgccttggcctgccaaagtgctgggattacagacatgagccacctcacgtggttgagattttttcactttaagaaatgctttttctgtcacctc

SEQ ID NO: 29389 - DNA, 201 bp, Homo sapiens
tgttgttaaggatgaaatgaaaagtccacagcataagcttgacacataaaataagcacccgatgaatactgactaaagagagaggaggagtaggggagagraggagagaagagaggaaatgaaaatgtttctgaataagttatgtctaagttttttcactttttattttttattgttttcaggacagggtcttgttccatt

SEQ ID NO: 29390 - DNA, 201 bp, Homo sapiens
atcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacata

SEQ ID NO: 29391 - DNA, 201 bp, Homo sapiens
tcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtagt

SEQ ID NO: 29392 - DNA, 201 bp, Homo sapiens
ctcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtag

SEQ ID NO: 29393 - DNA, 201 bp, Homo sapiens
ttattatgtaggtattcatatagcatttaaaatgtaatcattttaaaatgtagaaatcacttttagatcgtagaccataaaaaaacagcaggaaaaactasatggttggctggatttggccaagttgacatagagagccaatccctcatctccagcagggcttttactcaatgatacagtgcgcatgaattgcttggggga

SEQ ID NO: 29394 - DNA, 201 bp, Homo sapiens
agagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgcgca

SEQ ID NO: 29395 - DNA, 201 bp, Homo sapiens
ttgaacccgggaggcagaggttgcagtgagccgagatcacgccactgcactccagcttggcgacagagtgagtctccatctcaaagaaaaaaaaaaaaaaacaaaaacctgccctgcccagccatgcccaaacagagtggccagcagtcagcttagtgtgggcagagctcagggaattattctgcagtgcagctaacatct

SEQ ID NO: 29396 - DNA, 201 bp, Homo sapiens
aatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagcta

SEQ ID NO: 29397 - DNA, 201 bp, Homo sapiens
tgagagcatgctagtctccgaacggcctgccagggtgcctgacagccagagccacctaatgggcctatttgatcctggagttgctgtaatggcaagaaaawccatggcctccagccccagtgttgaagttttgacgctaatgtgatgataattctcttttctttgactggggacttgcctttgtttatctttttttgttgt

SEQ ID NO: 29398 - DNA, 201 bp, Homo sapiens
cagccttgaagacctggaataaatcccacttggtcatggcatatatgtttttttatacattgttggatacagtttgctaacattttgtggatagctcaccracttttattcagaaaacatccgtctcagtttagtgcccaacaaggaaagcatactgtttgttgggtgggttccatttttgtggttaggagaagaatatag

SEQ ID NO: 29399 - DNA, 201 bp, Homo sapiens
caacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttata

SEQ ID NO: 29400 - DNA, 201 bp, Homo sapiens
aatgaaatatatgtagggtttggaaccatctgaggctttaggcatctactgggggtcttggagtatatcccctgtgcagaagcggaggctactgtacatamatttgcctgtaagtgagcgcgttcttggattttgttgaatggtgccactgattatgggtcagagcttgttgaaagggtattaatccattatttactaaaa

SEQ ID NO: 29401 - DNA, 201 bp, Homo sapiens
aattttccaccttgccaaatttgaggtccccctcaacattaacggggaacccaatatcagttccttaaatgggagcaaagattgatgtcaatataaactakgacacacattcatattgcagaaagggtaagaaatccttacacagaacgagtacggtctctaacagtaaagtacagaacaggtggttctcattttagtata

SEQ ID NO: 29402 - DNA, 201 bp, Homo sapiens
acaatgggactagaacactctgcagagtatgaaggttgtgattcagttgcccaagcagtaaggcctgactggtgtcacgatcccacaacccgcacaaaggygccattgttgcccagtgtgaagggagctgaggcatcaccaaagggggccaagcgtcccttctctgggttagaaatgttgttttccatttgctggtaaaca

SEQ ID NO: 29403 - DNA, 201 bp, Homo sapiens
agtggagcaaaacagatgtgaaacatttgtgtcttaaagtgttttggtcaagagaaactaaattggttagaaagtgtgcaattttgcaagctttataaaartataaaccaatgagtctggactctgttccctaaaggggatgaggaatgaaaatgaaggtttgcaaagacatcttgccagacccttacatattttaattta

SEQ ID NO: 29404 - DNA, 201 bp, Homo sapiens
agcgagacttcttgtggaatgatgaatatgttcagggaggctgttgatggcaagaaaagaagggtgatgggttgggcttatattgtttagtggagcaaaasagatgtgaaacatttgtgtcttaaagtgttttggtcaagagaaactaaattggttagaaagtgtgcaattttgcaagctttataaaaatataaaccaatg

SEQ ID NO: 29405 - DNA, 201 bp, Homo sapiens
gaagtgcattccatggccctgtcccagccatagaaagaaatgcctttatttttaagcgagacttcttgtggaatgatgaatatgttcagggaggctgttgrtggcaagaaaagaagggtgatgggttgggcttatattgtttagtggagcaaaacagatgtgaaacatttgtgtcttaaagtgttttggtcaagagaaact

SEQ ID NO: 29406 - DNA, 201 bp, Homo sapiens
gaagacagggcaggagggtggtgtggcacaaaggcggctctgtctgacctgtcacgttaggactgagttcattcttgttcagattcagcatcttttgttayacccgaagtgcattccatggccctgtcccagccatagaaagaaatgcctttatttttaagcgagacttcttgtggaatgatgaatatgttcagggaggct

SEQ ID NO: 29407 - DNA, 201 bp, Homo sapiens
gagcgctcggcaaatggtcttaaaagcatccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaaga

SEQ ID NO: 29408 - DNA, 201 bp, Homo sapiens
atactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgt

SEQ ID NO: 29409 - DNA, 201 bp, Homo sapiens
attgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatg

SEQ ID NO: 29410 - DNA, 201 bp, Homo sapiens
aattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttat

SEQ ID NO: 29411 - DNA, 201 bp, Homo sapiens
agaagaaatatgggatgttttgcttcgggatggaggctggagcaggagtttctggagtctgccagtacccagtttgaatcccagctctgccttttatcagytgggtgttgggcaagttagctgacttttgtgagttttctcatcattaaaatgagaacactgttattggtctttcgggattgttttgagaaatgagatatc

SEQ ID NO: 29412 - DNA, 201 bp, Homo sapiens
tgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagc

SEQ ID NO: 29413 - DNA, 201 bp, Homo sapiens
tctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaacttt

SEQ ID NO: 29414 - DNA, 201 bp, Homo sapiens
ttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactt

SEQ ID NO: 29415 - DNA, 201 bp, Homo sapiens
gtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaac

SEQ ID NO: 29416 - DNA, 201 bp, Homo sapiens
ttctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgttttta

SEQ ID NO: 29417 - DNA, 201 bp, Homo sapiens
attctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgttttt

SEQ ID NO: 29418 - DNA, 201 bp, Homo sapiens
ggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggagggc

SEQ ID NO: 29419 - DNA, 201 bp, Homo sapiens
gggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggaggg

SEQ ID NO: 29420 - DNA, 201 bp, Homo sapiens
tgggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggagg

SEQ ID NO: 29421 - DNA, 201 bp, Homo sapiens
ccaaaaataagtcataagaacaacaaataataccaggaataaataatgtaaaatataaataattcctaaaatggtgataacagcttatgacaagtaatttyttttttttgagatggagtctcgctctgttgcccagggtagagtgcagtggtacagtctcggctcactgcaacctctgcaacccaggttcagtcgattctc

SEQ ID NO: 29422 - DNA, 201 bp, Homo sapiens
tttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagc

SEQ ID NO: 29423 - DNA, 201 bp, Homo sapiens
tgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgcct

SEQ ID NO: 29424 - DNA, 201 bp, Homo sapiens
atgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacatt

SEQ ID NO: 29425 - DNA, 201 bp, Homo sapiens
tgtcctttttaatttcctttttctagcaattctcaatgtttttttaaaatctcttctggaggagggtacccttcacaaagttatttgccaaaggtctgagraaaaaaaaagcctttcaccatggttagttcgagaagcacagcaatacagtacttctgctacgagtgtatacaggctgaggatgggtgctttgtggccctt

SEQ ID NO: 29426 - DNA, 201 bp, Homo sapiens
accactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttgt

SEQ ID NO: 29427 - DNA, 201 bp, Homo sapiens
caccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttg

SEQ ID NO: 29428 - DNA, 201 bp, Homo sapiens
tcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagtt

SEQ ID NO: 29429 - DNA, 201 bp, Homo sapiens
ctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagt

SEQ ID NO: 29430 - DNA, 201 bp, Homo sapiens
caacgctttgggaggctgaagcaggaggatcacttgagcctaggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcag

SEQ ID NO: 29431 - DNA, 201 bp, Homo sapiens
aaagacttggaaccaacccaaatgtccaacagtggtagactggattaagaaaatgtggcctttgcctcttttaaaaagttctaagttgctagccagtcggracaaatacagaatgtgaggtccctttccagccaatggaaaccggacacagcagtagagtacacgtgtcaggttataaatgagcctgtctcctttgtccgg

SEQ ID NO: 29432 - DNA, 201 bp, Homo sapiens
tgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatgg

SEQ ID NO: 29433 - DNA, 201 bp, Homo sapiens
ctcgtttttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctg

SEQ ID NO: 29434 - DNA, 201 bp, Homo sapiens
acagcttgcatgtgtagttaatttgttccaaatttccatcctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatcca

SEQ ID NO: 29435 - DNA, 201 bp, Homo sapiens
ataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtaatttgagacatgatgatttttgtcatgtaaataggatcag

SEQ ID NO: 29436 - DNA, 201 bp, Homo sapiens
acacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtga

SEQ ID NO: 29437 - DNA, 201 bp, Homo sapiens
caagtgtgcaccaccatgcctggctaatgtttgtatttttagtagggacggggtttcgccatgttggccaggctggtgtcaaactcctgatctcaggtgtwccaagaacaaaaggccaaccccattagacggtggccaagttggtgctgtgaacagggatcctgcctctgcctcccaaagtgatgggattacaggcgtgag

SEQ ID NO: 29438 - DNA, 201 bp, Homo sapiens
aaatatgtgtatatatatatttgttagggtaaaacaaagtctataaaaactgttttcctttgttattgcccccaccaaatatttatatatatatacacacmtatgtatatatgtatgtatagagagtctattatatatattacatatacataatatatacataatatataatagactctataatatagactctaataatta

SEQ ID NO: 29439 - DNA, 201 bp, Homo sapiens
ttattttaagttcaggggtccatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgc

SEQ ID NO: 29440 - DNA, 201 bp, Homo sapiens
tttggggggcaaaaacatatatataatgaatataattatataattcatataatatatgtaatagagcgtgtatattatttacatatgtatatatatatatwcacacacacacacacatttcaactttcttgaactcctgaaccagccttagattgcctagtaccagggttcttctttttttaaaaaatttatattttattt

SEQ ID NO: 29441 - DNA, 201 bp, Homo sapiens
atttggggggcaaaaacatatatataatgaatataattatataattcatataatatatgtaatagagcgtgtatattatttacatatgtatatatatatatacacacacacacacacatttcaactttcttgaactcctgaaccagccttagattgcctagtaccagggttcttctttttttaaaaaatttatattttatt

SEQ ID NO: 29442 - DNA, 201 bp, Homo sapiens
tatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtata

SEQ ID NO: 29443 - DNA, 201 bp, Homo sapiens
atatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactct

SEQ ID NO: 29444 - DNA, 201 bp, Homo sapiens
cggggtttcaccgtgttacccaggatggtctcgatctcctgacctcatgatccacctgccttggcctcccaaagtgctgggattacaggcgtgagccaccrcgcccgactgctttattttcctttgtgttcctaatacctggcccagtgtctggcaaatggaaagttcccctggatgtagttgggtgacactatgagtgta

SEQ ID NO: 29445 - DNA, 201 bp, Homo sapiens
ttgctgaatactgagtaaataaagaaaagttaacacagtggagtccaggtacagtggctcatgcctgtaatcccagcactttgggaggtcaaggcaggagratcacgtgagcccagcagttcaagaccagccttggcaacatggtgagaccccatctctacaaaaaataaaataattagctgggcatggtggtacatgcct

SEQ ID NO: 29446 - DNA, 201 bp, Homo sapiens
caagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgccca

SEQ ID NO: 29447 - DNA, 201 bp, Homo sapiens
ggaggaccttgtgttcctgctggagagtgagagtccctccctccccattccactcccaagagcagtgaagagtcaggaaggtgggcttgttttgttttgtdttgttttgttttgcttgttgagcaagggaatgcggttcccctgtgtcggacttgtttcagaaagacaatgtcactgaggctggggcagggagattagctg

SEQ ID NO: 29448 - DNA, 201 bp, Homo sapiens
acttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagaca

SEQ ID NO: 29449 - DNA, 201 bp, Homo sapiens
cacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagac

SEQ ID NO: 29450 - DNA, 201 bp, Homo sapiens
tcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagaga

SEQ ID NO: 29451 - DNA, 201 bp, Homo sapiens
atcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagag

SEQ ID NO: 29452 - DNA, 201 bp, Homo sapiens
gcatagggtttggggaggattaaataagataatgtaaatagagtttagcgtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcatt

SEQ ID NO: 29453 - DNA, 201 bp, Homo sapiens
ttcggccctgatttcagagatgaaagaaccaaggcatagaaattgagtcactttctggagtgtacacaactagtaagtggattcgagttagttttgctctrttccaaggctacttactatgctatttttggtttcctacttttgttcaacttatatttatctgattatctgattctcttttacaagcacttagtgagcatc

SEQ ID NO: 29454 - DNA, 201 bp, Homo sapiens
gatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctccta

SEQ ID NO: 29455 - DNA, 201 bp, Homo sapiens
tcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatcccg

SEQ ID NO: 29456 - DNA, 201 bp, Homo sapiens
gtcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatccc

SEQ ID NO: 29457 - DNA, 201 bp, Homo sapiens
aagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactgggccggacccatgggtatgaattcata

SEQ ID NO: 29458 - DNA, 201 bp, Homo sapiens
gctccctggaagatggatcttgccttgtggatgtttttctaccgtgacagaagatagaaaggatgaaatagaaagagtgtgagtgaattctgcacccaccmcccccccccagcttccccacctgtaaaatgatttgctcaaagtttgcaaagaatggaggcatattcaaagtgctcagcactgggccggacccatgggtat

SEQ ID NO: 29459 - DNA, 201 bp, Homo sapiens
ccaatccttgcactgaagcttttagcaggaaaggtgaacagaggcatctggatgcatcgcggccagtctgccccttgcccaattccctcccctctcctgcstacaggtcatccctgagaagtgtgcctgtggactgcgttctttggggtaggacatggaatgggaagatgaaaagaaagccttcctttttctgtcctcagc

SEQ ID NO: 29460 - DNA, 201 bp, Homo sapiens
aaatactcccttctggacactggaagggcaaatgaggtgcaagccttttttttttctttcttttcttcttcttcttcttctttttttttttttttttttgkttttcctcccagcctctctcctttcccattatgcacaatgcgctgagaaaggattcccagtccccctggtaaaaagtctgaaggatgccgaggagttcac

SEQ ID NO: 29461 - DNA, 201 bp, Homo sapiens
agaaatactcccttctggacactggaagggcaaatgaggtgcaagccttttttttttctttcttttcttcttcttcttcttctttttttttttttttttttgtttttcctcccagcctctctcctttcccattatgcacaatgcgctgagaaaggattcccagtccccctggtaaaaagtctgaaggatgccgaggagttc

SEQ ID NO: 29462 - DNA, 201 bp, Homo sapiens
atggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccgggg

SEQ ID NO: 29463 - DNA, 201 bp, Homo sapiens
aatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggg

SEQ ID NO: 29464 - DNA, 201 bp, Homo sapiens
taatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccgg

SEQ ID NO: 29465 - DNA, 201 bp, Homo sapiens
gtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccg

SEQ ID NO: 29466 - DNA, 201 bp, Homo sapiens
gtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctca

SEQ ID NO: 29467 - DNA, 201 bp, Homo sapiens
ggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctc

SEQ ID NO: 29468 - DNA, 201 bp, Homo sapiens
taaaggtccccagtggtccaggtttttccttctcagcttggaaagcagcaggaaaactgcactgcatttatccaaagggtgtgattggtaagtgtgggtastgatatagaataaatcaacgtggctgggtgcagtggctcacgtctataatcccattactttgggaggccaaggtgggtggatcacaaggtcaggagattg

SEQ ID NO: 29469 - DNA, 201 bp, Homo sapiens
caccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgca

SEQ ID NO: 29470 - DNA, 201 bp, Homo sapiens
ttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgt

SEQ ID NO: 29471 - DNA, 201 bp, Homo sapiens
gcatttgggattaacagctaaagatagcaggattccttctaaagcaataaaaatgttgtaaagttgattgtggaaattctttcacaactctttgattgtastaaaactttgaacactttaaatgggtgaattgtatggtatatgaatcatatctcaacaaagctgttaaaaaattgtatgaaaactgtgatgggattcaag

SEQ ID NO: 29472 - DNA, 201 bp, Homo sapiens
ctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaaca

SEQ ID NO: 29473 - DNA, 201 bp, Homo sapiens
ctctctctctctctttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacag

SEQ ID NO: 29474 - DNA, 201 bp, Homo sapiens
gtatgtgtttaatctaccattccttgtggcacagtgcgtggtctgcatggcacagtgtgtggtctgtatggcacagtgcatggtccgcatggcacagcgcrtggtccgcgtggcacagcgcgtggtccgcgtggcacagcgcgtggtccgcgtggcacagcgcgtggtctgcgtggcacagtgcgtggtctgcatggcaca

SEQ ID NO: 29475 - DNA, 201 bp, Homo sapiens
ggtctggattcaaatcacatgtgccaactgttctactttggcagaattacctactgctttgggcctcgggtactaaatttgtgaaatgggaaaaataatasttcccacctcatagagttgcagtggagattgaatgagtttgtagataaaaagcgtctgcgttgtgtctggtacatggtaaggggttcgtaaatactgagt

SEQ ID NO: 29476 - DNA, 201 bp, Homo sapiens
atactgtctatagaagttttggttctgcttttgaccttaacactaaaatacccttccataatattataggcttttcatgtacatcgtttttaagatggctrtaaattccacttagtggctatgactgtagttttttttttaactcttcccctaatagtgaaaatttagattgtttctaaattttccttactataagtaagg

SEQ ID NO: 29477 - DNA, 201 bp, Homo sapiens
actgtacaccccctatcctggcatctaaacatatttgtaatcatactgtctatagaagttttggttctgcttttgaccttaacactaaaatacccttccayaatattataggcttttcatgtacatcgtttttaagatggctataaattccacttagtggctatgactgtagttttttttttaactcttcccctaatagtg

SEQ ID NO: 29478 - DNA, 201 bp, Homo sapiens
taacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccag

SEQ ID NO: 29479 - DNA, 201 bp, Homo sapiens
cccaaagtgctgagattacatgcatgagccaccatgcctggcctctggccttcttttcactttagaaaaaaacaaaaaacaaaaaacaaaaaaaaacacamaaaaaacttttttttttagaactgttttagtttgggagccaaaattgagcagaaagtacagagagttcccgtatacctccggcagagccctggctcacta

SEQ ID NO: 29480 - DNA, 201 bp, Homo sapiens
agcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggct

SEQ ID NO: 29481 - DNA, 201 bp, Homo sapiens
gagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaa

SEQ ID NO: 29482 - DNA, 201 bp, Homo sapiens
ctcagtttcctgagtagctgagaccacaggcacgggacaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccgcagagagaaagtg

SEQ ID NO: 29483 - DNA, 201 bp, Homo sapiens
tgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggacaccatgccagtctaatttttaaattttttgt

SEQ ID NO: 29484 - DNA, 201 bp, Homo sapiens
tcagagtaggcatgattgcatattctttagatggatgggtggatggatggatggatggttggatggttgggtggatgtatggttggatgattggatggatsatggttgagtgagtgggtggatggataggtggaaggatgaatggatgcatggctgagtggatagaaggtggatggatggagggatggatggttggatggt

SEQ ID NO: 29485 - DNA, 201 bp, Homo sapiens
ctgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcag

SEQ ID NO: 29486 - DNA, 201 bp, Homo sapiens
aaaaagatgttgggttggaaagctaagttacagcaggtgaacttgaatttgaggaaagacaaagcaaaccctggctattaaaggaacacacacacacacayacacacacacacacacacacacgtttctggtattaggaaatggagatttctaacataataaaaaagattgaacttaaaaatgacttccattaaatagggt

SEQ ID NO: 29487 - DNA, 201 bp, Homo sapiens
cctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgaggaaacgctctcttcttcttgcaggg

SEQ ID NO: 29488 - DNA, 201 bp, Homo sapiens
cacgcaggcattaaatggattgtgaagagggactttgttcccgctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaag

SEQ ID NO: 29489 - DNA, 201 bp, Homo sapiens
ttactgtttatatacccggccacttctgccaaaatatgctggccttttagtcttttggttttttctctcttttggtttgttggcttatgttcgctgcttgrtctgactactggttttatttctaaggatttttttttaagttggcatctttttttctttgactttccttgtatgcccccctttctcccctgcattgtcttg

SEQ ID NO: 29490 - DNA, 201 bp, Homo sapiens
ttgaccaatttttgtaaatctcttctgttactgtttatatacccggccacttctgccaaaatatgctggccttttagtcttttggttttttctctcttttkgtttgttggcttatgttcgctgcttgatctgactactggttttatttctaaggatttttttttaagttggcatctttttttctttgactttccttgtatg

SEQ ID NO: 29491 - DNA, 201 bp, Homo sapiens
ctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcc

SEQ ID NO: 29492 - DNA, 201 bp, Homo sapiens
tactgaaatggcttagaatgccattttatcacatggtcaaattattcaatgatcaaatatcgaattattaaaaattatcaaaaggaagttccctgaaacaygaaagtgtttgggctttgtaggtacccaagtctactgggaaaaatccccatttctgggtaacccagccccttttaatgacaacttcagttctccaaattc

SEQ ID NO: 29493 - DNA, 201 bp, Homo sapiens
gagaggatgtagagaaataggaacacttttacactgttggtgggactgtaaaccagttcaaccattgtggaagacattgtggcgattcctcaaggatctasaactagaaataccatttgacccagccatcccattactgggtatatacccaaaggattatatatcatgctgctataaagacacatgcacatgtatgtttat

SEQ ID NO: 29494 - DNA, 201 bp, Homo sapiens
gtttctttgacttactggaaaaaaaaataataggaaagaaaatgtgatcagttggtatatttggctctctttcatcaacacttttatggacctgcattgcwgtgtttctgtgatgtgtataaaacacagtttcagtgatcgtgcaagcctcagttttagaagataaaaagatatgaacttgaacccaagcttctctgtcaa

SEQ ID NO: 29495 - DNA, 201 bp, Homo sapiens
cccagacacttacatattcctagccattccttttgcttaagtttgcagagatttgtgcttaaaactgaataaacaatctcagggtttttgtgtgtgtgtgkatgtgtgtgtgcgtgttatatgaagtcttgctagaatgcataaacaaacaaaaaaaatatcatactctcagatcctggatactgtggtcgcctggacttc

SEQ ID NO: 29496 - DNA, 201 bp, Homo sapiens
agaaaagagctttggaaattctacatacataatatatataaattttccattcatagtgtgttagcagctttttctacaaatctcttggcgggtggggggayatttcactcttctatgaatcaaataatatatggctttttcctattggaaaaaattagtcgtgtgaactttattcttcaagaaaaagtagtttttatctgc

SEQ ID NO: 29497 - DNA, 201 bp, Homo sapiens
cgcactgtgccagaatagatacagctacgtcaaaatgccgcatttattttgccattacttttcactgactaaaaccatttgctaatgaaagttctagctgmcataatttcagcacctgctgatggaaaggtggactcactggtcatggggagtacagtaaaattaggagagtagatagaatcctgaagcatttgagctgca

SEQ ID NO: 29498 - DNA, 201 bp, Homo sapiens
tgccaaagcgtctgcagaccagtctgtacagttgattatagatatattaatgaccacttctgagctaaaaaatgatctagaataatagactaccaaacacrtaagcttatttacggtttgcctccttctcatgcttttggaagggaagcactgagggtcattgtatcagtcagcgtagactaggtttgccgcagtaacaaa

SEQ ID NO: 29499 - DNA, 201 bp, Homo sapiens
tttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgc

SEQ ID NO: 29500 - DNA, 201 bp, Homo sapiens
gcagagctggctgtgtgggagaccagagttttattattactcaaataagtctcccccaaaactcagggatagagatttttaaggagaatttagtgagaagrgggtcagggaatggggagtattgattggtcaggtttaagatggaatcagggagttgaagctggcctcttgcactgagtcagttcctgggtgggagccaca

SEQ ID NO: 29501 - DNA, 201 bp, Homo sapiens; identical to SEQ ID NO: 4893

SEQ ID NO: 29502 - DNA, 201 bp, Homo sapiens; identical to SEQ ID NO: 4889

SEQ ID NO: 29503 - DNA, 201 bp, Homo sapiens; identical to SEQ ID NO: 4885

SEQ ID NO: 29504 - DNA, 201 bp, Homo sapiens
ttaaattcaggactttaagcttatattccctccttgggctaccaaaacggagatgtgcaatatacaagccctcctgacttttttttttttttttttttttyctgcagagagcgttgctgctccttctctattttatttctttattactgtttttttaaatgaaggagtcagtaacaaaccgttcatcattttgccagagta

SEQ ID NO: 29505 - DNA, 201 bp, Homo sapiens
gttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagt

SEQ ID NO: 29506 - DNA, 201 bp, Homo sapiens
taatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaa

SEQ ID NO: 29507 - DNA, 201 bp, Homo sapiens
ctaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattcctta

SEQ ID NO: 29508 - DNA, 201 bp, Homo sapiens
agcttctatcctatgaaagtgaatataaaattcttaaagtttatagggtctgctgggtttaaggaggagaaatttgagttttcatattgtcagtctcaaascttttctgaaattggaagtgatgaagtgacagtctggctatatgtgtgtgtgtgtggtgtgtgtgtgtgtgtgtgtgtgtgtgtgtgtgtgtgtgtgtgt

SEQ ID NO: 29509 - DNA, 201 bp, Homo sapiens
tcgaactagttcaccaaagcttctatcctatgaaagtgaatataaaattcttaaagtttatagggtctgctgggtttaaggaggagaaatttgagttttcrtattgtcagtctcaaaccttttctgaaattggaagtgatgaagtgacagtctggctatatgtgtgtgtgtgtggtgtgtgtgtgtgtgtgtgtgtgtgtg

SEQ ID NO: 29510 - DNA, 201 bp, Homo sapiens
actgttttaagacacttggtacacattgatatgtattgtccaattgctttccagaaactatataaaatattacaaagaaaaacatatatatatatatatatgtaaaatatatatatgaagggagaaataaatgtaaatgaaaagaaaaacatatagagaaagaatatgtctaaaagaaactgcagaggcagctataattaa

SEQ ID NO: 29511 - DNA, 201 bp, Homo sapiens
aactgttttaagacacttggtacacattgatatgtattgtccaattgctttccagaaactatataaaatattacaaagaaaaacatatatatatatatatatgtaaaatatatatatgaagggagaaataaatgtaaatgaaaagaaaaacatatagagaaagaatatgtctaaaagaaactgcagaggcagctataatta

SEQ ID NO: 29512 - DNA, 201 bp, Homo sapiens
aaactgttttaagacacttggtacacattgatatgtattgtccaattgctttccagaaactatataaaatattacaaagaaaaacatatatatatatatawatgtaaaatatatatatgaagggagaaataaatgtaaatgaaaagaaaaacatatagagaaagaatatgtctaaaagaaactgcagaggcagctataatt

SEQ ID NO: 29513 - DNA, 201 bp, Homo sapiens
gtcttgaagtcctgaccttaagtgatccaccctcctcggcctcccaaagtgctcggattacaggcatgaaccactgcgcctgactgtacttttttttttttaaagtatacccatacccattgtacacatttggtattttttctttaaaaaaaaaaagcatttactttttgcctcatgaatctctgagtacattttgtgcat

SEQ ID NO: 29514 - DNA, 201 bp, Homo sapiens
cagagcaagagtccatttacaaaacaaaaacaaagaactgacaataaatagttttctccgttttgtgacttatttttaattattaagaataagtgtcataragccaatactttctaacatgtgtatagtatgttatagttttcaaagtctttgacaattatacctagggagccaggacagtatttgtatcatcatttcatt

SEQ ID NO: 29515 - DNA, 201 bp, Homo sapiens
gttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcag

SEQ ID NO: 29516 - DNA, 201 bp, Homo sapiens
ggcaggagaatccctatggtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagc

SEQ ID NO: 29517 - DNA, 201 bp, Homo sapiens
acttcttattttaatattgtacccattgtactttagtctaagtgatggctgcttatggccatgccctttcttctgcactttgggtgttttgtctggaattktctctcctttccttttgtgaaaaaggatgaattttccgagactctgttatgacagaaactcaccagttctctgttgttaatcaacaaatagattgtgaat

SEQ ID NO: 29518 - DNA, 201 bp, Homo sapiens
tgactttcttacctacgctaccttataatccttttataaattttgctttacgttttaacaacggaaaacacttaaggtttttttcctttctttttttttttaattcttccgccagctatctttaaaagcagttctaaaacttcttattttaatattgtacccattgtactttagtctaagtgatggctgcttatggccatg

SEQ ID NO: 29519 - DNA, 201 bp, Homo sapiens
ctttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccg

SEQ ID NO: 29520 - DNA, 201 bp, Homo sapiens
ataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcag

SEQ ID NO: 29521 - DNA, 201 bp, Homo sapiens
caaccaatggtacagttcatgtctgagtctgagcagctgagaagcaggagataaaaaggcatcagttccattccatatccaagtctgagtccaagggcagsagaagctgatgtctcagcttgaagtcaggcatagagaggcaattctttctcactcagccttttattttattcaggccttcaacagattgtatgaagccac

SEQ ID NO: 29522 - DNA, 201 bp, Homo sapiens
gtgctgggattacaggtgtgagccaccacggctggccaatatctactagttttgaaattaaaaaaaaaaaaaaaaaaatatatatatatatatatatatakatatatgaaaaaaaggacaaacgatttcagttgcacaactataatcgatgaagtggctccttgatgttctcggggcaatctgagacactggggagaaccc

SEQ ID NO: 29523 - DNA, 201 bp, Homo sapiens
ccacctcagcctcccaaagtgctgggattacaggtgtgagccaccacggctggccaatatctactagttttgaaattaaaaaaaaaaaaaaaaaaatatawatatatatatatatatatatatatgaaaaaaaggacaaacgatttcagttgcacaactataatcgatgaagtggctccttgatgttctcggggcaatctg

SEQ ID NO: 29524 - DNA, 201 bp, Homo sapiens
tcccacctcagcctcccaaagtgctgggattacaggtgtgagccaccacggctggccaatatctactagttttgaaattaaaaaaaaaaaaaaaaaaatawatatatatatatatatatatatatatgaaaaaaaggacaaacgatttcagttgcacaactataatcgatgaagtggctccttgatgttctcggggcaatc

SEQ ID NO: 29525 - DNA, 201 bp, Homo sapiens
cctcccacctcagcctcccaaagtgctgggattacaggtgtgagccaccacggctggccaatatctactagttttgaaattaaaaaaaaaaaaaaaaaaawatatatatatatatatatatatatatatgaaaaaaaggacaaacgatttcagttgcacaactataatcgatgaagtggctccttgatgttctcggggcaa

SEQ ID NO: 29526 - DNA, 201 bp, Homo sapiens
ttctttagtggcgatttatcagatttcagtgtacccatctgagcagcatatgctgtacccaatatgtagtcatatatatatatgtgtgtgtgtgtgtgtgkatgtatatatatgtgtgtgtatgtatatatatgtatgtatctgtatatgtataatggctgtacatgatataattttgagttggaaaaagcaaattgaaga

SEQ ID NO: 29527 - DNA, 201 bp, Homo sapiens
atagcaaaaaaaggaaaaatgaaagaaattaaaaagatacctctatatacatacattgtgtgtttgtgtgtgtgtgtgtgtgtgtgtgtgtgtgtgtgtgkataaattggctgtgcatgatataagtttttatttcaatcgttttaggggtaaagtggtttttgattacatggagaagttctttagtggcgatttatcaga

SEQ ID NO: 29528 - DNA, 201 bp, Homo sapiens
tacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcatttttttttttaacagttagatttactcttcctttgcacagactaatagcaca

SEQ ID NO: 29529 - DNA, 201 bp, Homo sapiens
atacaggcactttgtctcccagtggaatataagttctttgaggccaaggactgtgtcttattctgtgttgcatccctttggcttcagcctcattgtcttgmgtttattaagcatttggaacatttcagctgaatgagtgaatgagtgaatgagtgaagccatcagtcaaatcagaacactgctcacacatgcatcccaagt

SEQ ID NO: 29530 - DNA, 201 bp, Homo sapiens
attctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctct

SEQ ID NO: 29531 - DNA, 201 bp, Homo sapiens
cattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctc

SEQ ID NO: 29532 - DNA, 201 bp, Homo sapiens
cagcactttgggaggccaaggtgggtgggtcacctgaggtcaggacttcgagaccagcctggccaacatggtgaaaccgcatctctactaaaaataaaaawaaaaaaaaattagccaggcatggtggtgcatgtctgttatcccagctacttgggaggctaaggcaggagaatcacttgaacctgggaggcagcggttgca

SEQ ID NO: 29533 - DNA, 201 bp, Homo sapiens
tggtagctcatgcctgtaatcccagcactttgggaggccaaggtgggtgggtcacctgaggtcaggacttcgagaccagcctggccaacatggtgaaaccscatctctactaaaaataaaaaaaaaaaaaaattagccaggcatggtggtgcatgtctgttatcccagctacttgggaggctaaggcaggagaatcacttg

SEQ ID NO: 29534 - DNA, 201 bp, Homo sapiens
gagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcag

SEQ ID NO: 29535 - DNA, 201 bp, Homo sapiens
gtgaaatgagccccggctcagcaggccagttgtcttcagtgacccccagtgaggcagcaggtgggacttgattctggaggcaagactcaactccatagacrgggcttacacaccggaccaaattgaggactagctaaaacagggatagggtgggtgcacctttccatgagctgtgtccgccagtgtgtcatgtcagtttac

SEQ ID NO: 29536 - DNA, 201 bp, Homo sapiens
tggagctaaggaatgaaaagttgcttaaacattttcctgttgccagtttttcttaaacattagtgctattcttttttttttttttttttttttttttttttccttcttcaaccctgactctgattcacaaagaatagggaagcttagccaactgcagtttcaaagtattgcttcttaagcctgggccaagtgtgtagactt

SEQ ID NO: 29537 - DNA, 201 bp, Homo sapiens
caagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggt

SEQ ID NO: 29538 - DNA, 201 bp, Homo sapiens
cgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttag

SEQ ID NO: 29539 - DNA, 201 bp, Homo sapiens
agttcctctccaaactgtcaaggacagtgccaagatctgcgaatatagaaagattaagagtttttttctgccttgttgggtcttctttctagcatgccagsaacatttttctcatcttttgaacattagggaataacacccaatgccaccctataatctcgagacagaagtggaggatcctcttaagacaagaaatctttc

SEQ ID NO: 29540 - DNA, 201 bp, Homo sapiens
tcacagctttctgcagcattgaccttgtgggctcaagcaatcctcctgcctcagcctcccaagtagcttagaaccacaggcatataccaccatacctggayatgtttttaactttaatttttatttttgtagagatgaggtctccctatgttgcccaggttgctctcaaactcctaggctcaagcagtcttcccaccctgg

SEQ ID NO: 29541 - DNA, 201 bp, Homo sapiens
aattgttacagagagaaagagggtaggtctgtgaatggaattgaacaggtaggttgaacaagataaatgccgaggaagcaagtgtatttaaataaacagtwgtttatggaaggctttggaaatccactatattaatctggaattttatgaaattttaccagaacttaaattattaatagttgaggacaaagaccaaccatt

SEQ ID NO: 29542 - DNA, 201 bp, Homo sapiens
gtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagct

SEQ ID NO: 29543 - DNA, 201 bp, Homo sapiens
agtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagc

SEQ ID NO: 29544 - DNA, 201 bp, Homo sapiens
tttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgc

SEQ ID NO: 29545 - DNA, 201 bp, Homo sapiens
ccaaataagaacacataattacaagactgtattgtataatcatgcaggacacaaggtatgcaattttaagggtcaaagtggtaaaaaaaaaaaaaaaaaawggaaaatcaaatataaaaaggcagccccgacaggtacgagcttgtagtcatttccccaaatgcctaaagtagacccattcccattgctctaatttgtaga

SEQ ID NO: 29546 - DNA, 201 bp, Homo sapiens
cccaaataagaacacataattacaagactgtattgtataatcatgcaggacacaaggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtag

SEQ ID NO: 29547 - DNA, 201 bp, Homo sapiens
aaaatatttgaaaaaaaaaagtgaaatttttgatatagaagaggatgtagggcaggtagggctcagaaggacccatgccatatagcaaagttcttagtaayacaggctttgggttacagcaggctagattcaaatcctgctgtggtcagaatgtctgtgtcaccccagcattcatttgttaggagatggggtcttttggga

SEQ ID NO: 29548 - DNA, 201 bp, Homo sapiens
taatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggat

SEQ ID NO: 29549 - DNA, 201 bp, Homo sapiens
tgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcact

SEQ ID NO: 29550 - DNA, 201 bp, Homo sapiens
cccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaa

SEQ ID NO: 29551 - DNA, 201 bp, Homo sapiens
ctgtcgtggtcttggcctttctcttgtgttccccagatgggtttcactgctctaaggatcataccttcgcaggccatctgaagttagtgaatctgaggcawacagaagggctgggtgcggtggctcatacctgtaatcccagcactttgggataatgagatgggtggatcacctgaggtcagaagttcgagaccagcctgg

SEQ ID NO: 29552 - DNA, 201 bp, Homo sapiens
ttgtttcaggattattattttttttaaatttattttatttttttgggacagggtcttgctctgttgcccgggctggagtgcagtggtgcgatctcagctcmctgcaacctgcttcctgggttcaggtgattgtcctgcctcagcctccctagtagctgggattacaggcgcacgccagcacgcctgactgatttctgtatt

SEQ ID NO: 29553 - DNA, 201 bp, Homo sapiens
ctaggaagggctggaaagctccatgcccctaccccatacctcgccctatgtgtcttttcatctctgtccttagtactgtcctttataataaagcagtaagkggtagcaagtgttttcctgagttctgtcatctgctccagcaaattaatcaaacccaaagagggggttatgggaacttccacctgaagcccctcagccaga

SEQ ID NO: 29554 - DNA, 201 bp, Homo sapiens
cagtctattgttacaatattgcgtgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcccataaaa

SEQ ID NO: 29555 - DNA, 201 bp, Homo sapiens
aataagcccatttgaagtgtaacattcaactttttttagtatattcgcatggttatgtaattttcatcaaaatctaattttagagtatctttttgtccccstaaaagtaactctgtgcccatagttggcagtttgtcatatcactcaatcactgtttcctttaaagagcttatcattaaagacagcaggcagttacacaac

SEQ ID NO: 29556 - DNA, 201 bp, Homo sapiens
atggttttaaaataccaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctggg

SEQ ID NO: 29557 - DNA, 201 bp, Homo sapiens
atgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatttc

SEQ ID NO: 29558 - DNA, 201 bp, Homo sapiens
catgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatattt

SEQ ID NO: 29559 - DNA, 201 bp, Homo sapiens
acatgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatt

SEQ ID NO: 29560 - DNA, 201 bp, Homo sapiens
gactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatg

SEQ ID NO: 29561 - DNA, 201 bp, Homo sapiens
cgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgat

SEQ ID NO: 29562 - DNA, 201 bp, Homo sapiens
ccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtga

SEQ ID NO: 29563 - DNA, 201 bp, Homo sapiens
cccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtg

SEQ ID NO: 29564 - DNA, 201 bp, Homo sapiens
tgaacccaggaggtggaagttgtagtgagccaagatcgcatcactgcactccagcctgggtgacagagtgagactccatctgaaaaaaaaaaaaaaaaaaagacatttacattttatctttactgtagctatggctgcctatcccaaggatgggaagtctgaagttcaaactggtgatgatccccaccccaagtcacacag

SEQ ID NO: 29565 - DNA, 201 bp, Homo sapiens
atgctaaggtaggagaatcgcttgaacccaggaggtggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatg

SEQ ID NO: 29566 - DNA, 201 bp, Homo sapiens
tttacagagtatatgtgttttcagattttgcatgacattttaggataaatgtgatgaaaatgaggaaaattgggaatgaagtttaggtcagaaaagtttcrgtgattattttttcagaatcattgtttcttggtttctagggtccaacatgccattgttcaatggctgtatttcaatggctgtatttcagaggctgtattt

SEQ ID NO: 29567 - DNA, 201 bp, Homo sapiens
gaacagggagcttggctgcaaaacgattattgtatttaacttctgttggcatcattcgcatacttgtatgggagatccagaattggaatttaacacagttktcccaggcccttcatggaatttgaaaacatgactctgaaagcatgtggctgaaatgagactctttcacactgtttaaagatgcatgtgcatatgttggtg

SEQ ID NO: 29568 - DNA, 201 bp, Homo sapiens
atttcaggaatgttcagctgttgcctagcttggaatggaccatcctctggtcccacccatgggtaagtcattggctgcagagcgcagacatttggctcccytcgggacattcctccctcatttaaaacaatgaggcgggcagcagggtactttgtcccttgtgttagctgaagttggaggatgctgtgttgatgggaaaac

SEQ ID NO: 29569 - DNA, 201 bp, Homo sapiens
cacaccccatgttccttctactacaacttctggctctggcttctggactgtcagtcattagcactccctatccctaagatttcaggaatgttcagctgttkcctagcttggaatggaccatcctctggtcccacccatgggtaagtcattggctgcagagcgcagacatttggctcccttcgggacattcctccctcattt

SEQ ID NO: 29570 - DNA, 201 bp, Homo sapiens
ccgagtttgtgttctccgattccacaccccatgttccttctactacaacttctggctctggcttctggactgtcagtcattagcactccctatccctaagrtttcaggaatgttcagctgttgcctagcttggaatggaccatcctctggtcccacccatgggtaagtcattggctgcagagcgcagacatttggctccct

SEQ ID NO: 29571 - DNA, 201 bp, Homo sapiens
caaaaagaaattaggtaacttgctcagtggctagtgagtggctagattgtaagcttcatgagggcaggggactttgacgattttgtcggtatcctaagccsctagaacagtgcctaaacatttgttgggcagttaatatatatttgttctattaataagtagagcccgagtttgtgttctccgattccacaccccatgttc

SEQ ID NO: 29572 - DNA, 201 bp, Homo sapiens
tactagctaattccaggcttcaagccactggggcataggcatatgtttagctcattccacaggaggggaacagaggctcaaagaacctaggtaagttggcyaggcgcggtggctcacacctgtaatctcagcgctttgtggggcttaggcaggaggattgcttgagctcagaagtttgagaccagcctggacaacatagcg

SEQ ID NO: 29573 - DNA, 201 bp, Homo sapiens
ctttttttaacttgtattttgggttcaggggtacatgtgcaggtttgttatataggtaacttcatgtcacaaaggtttgttgaacagattatttcatcacscaggtaataagccttgtatccaatagttatttttctgatcctctccttcctctctccctctaccctcaggcaggccccagtgtctgttgttctttctttg

SEQ ID NO: 29574 - DNA, 201 bp, Homo sapiens
atgatacttccctctcagtgtattttaccaagggattattagtgtatatgtgtgttcttactggaaatgttaattggacttgtaattctttttttaacttktattttgggttcaggggtacatgtgcaggtttgttatataggtaacttcatgtcacaaaggtttgttgaacagattatttcatcacgcaggtaataagcc

SEQ ID NO: 29575 - DNA, 201 bp, Homo sapiens
tttgaaaagaatagtacaaaaatgatacttccctctcagtgtattttaccaagggattattagtgtatatgtgtgttcttactggaaatgttaattggacytgtaattctttttttaacttgtattttgggttcaggggtacatgtgcaggtttgttatataggtaacttcatgtcacaaaggtttgttgaacagattatt

SEQ ID NO: 29576 - DNA, 201 bp, Homo sapiens
tgcagtgagccaagattgtgccactgcacttcagcttgggcaacagagtaagactctgtctcacaataaataaataaataaataaataaataaataaatawgagttggatcacagcaaaggtgagctttaacgagttcagtctagctctctcacaaaaaaaaagttaaaatgacaaattttgtgttacatacattgtacta

SEQ ID NO: 29577 - DNA, 201 bp, Homo sapiens
ctgacttactctttgaaaagatcgctctggctgctgtgttgagtggattggtaagggacaggtggtgaagactgaaacagggtatccagttaggaagctaycacagtgatccaacccccagcttctgttgaggttgaagaacctgcatgcccaacctaaatatatgttcaaaggtggttattactgtttgaggtgatgaaa

SEQ ID NO: 29578 - DNA, 201 bp, Homo sapiens
gacatgaaggaagggattgctggaggcagaacattctaggcagaaggaaccgcacgtgcaaaggccctcaggtcagccggcatggcatgcaagtaagccasctgcaacacagcaggtgtggatgaagggaagagaattagcatttggccagagcacgcattttaagggatggagatccatttggatagtcttgaacacaga

SEQ ID NO: 29579 - DNA, 201 bp, Homo sapiens
tggtgggtcatgcatgtaatcccagcactttgggaatacgaggtgggccaatcactgaggtcaggagttcgagaccagcctggccaacatggtgaaacccygtctctactaaaaatacaaaagttagtcggggttggtggtgtgctcctgtagttccagctacttgggaggctgaggcaggagaatcacttgaatccggga

SEQ ID NO: 29580 - DNA, 201 bp, Homo sapiens
gtcactctaattgcccagcgttttaattatcggcgtgttttatgcttttgtgaaatgctcatttcacagcttgctggtgggtctttttgtggaacgagaargtgaatattcacaccagaaatgaggtactgaccctgaagggctttccagtcaaagagaaaggagagcatgacccgccaatgccgttgtttgtaagcagga

SEQ ID NO: 29581 - DNA, 201 bp, Homo sapiens
tgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaat

SEQ ID NO: 29582 - DNA, 201 bp, Homo sapiens
ccttggccttttctgggctactcaaaaaaggattccaccaggtaaacttgaatcacctagcgctggtagaaagccttgctcttcgtcatctctcctgtgtrtcgctagccttattaaaatgtgcagaggagaccgggcatggtagcacacttgtaatctcagcacttggagaggctgaggtgggagaattgcttgaggcta

SEQ ID NO: 29583 - DNA, 201 bp, Homo sapiens
ttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctattttt

SEQ ID NO: 29584 - DNA, 201 bp, Homo sapiens
ggatttcctgctcttaaggttttttgtttttgtttttctctccaaataaatggtatttattaaataaaaattcattttctcatttatcaaccagttgcagyctttggatgttttaattatataaaaaaagcatggaaactgggcattttaattagcaagtacagccttgacacaaataaaggcatggctttggttatgcag

SEQ ID NO: 29585 - DNA, 201 bp, Homo sapiens
cagtttactaaaaataacaaaacattcttccatcagtcatgcatgccttatatttatgtagatacaaaaatagagtttgatattaaacaatactccaagamagccatttctgcagagttaaaaaatacgtaggttcagttccttaccaacacgtagacatgttgtgatgaaagaaggaaaggaaggaaggaaggaggaagg

SEQ ID NO: 29586 - DNA, 201 bp, Homo sapiens
aacataactgtaagaatttatcagattatatatatatatatttatcagattatatatatatttatcagattttatatatatatatatatatatatatatatgcatatgtttgtatataaatatacatgtaaagacccaaaactcatataaaaagacaaggtgatacagcattttaaaacagtttactaaaaataacaaaac

SEQ ID NO: 29587 - DNA, 201 bp, Homo sapiens
caacataactgtaagaatttatcagattatatatatatatatttatcagattatatatatatttatcagattttatatatatatatatatatatatatatatgcatatgtttgtatataaatatacatgtaaagacccaaaactcatataaaaagacaaggtgatacagcattttaaaacagtttactaaaaataacaaaa

SEQ ID NO: 29588 - DNA, 201 bp, Homo sapiens
gagtgctgtttcaaacagttgaaaccattcctacttccaaaaagaatttgactcaaaagggaatagtacactacatataaaagacagatgtatttaatttrtgtttcgaactacatatcagaaattagttagaagaagatatgagataaatatacctggaaactttatgaattatttctgacatctagcattaaatttagc

SEQ ID NO: 29589 - DNA, 201 bp, Homo sapiens
aaattttcatagacatccaccccctcactgccacaccccctcatagatttcttcttttcctcctccttctcctcctccctcttcctcctctttttcccccmccttcaaatagttccaagaccagagttgagggtgggtgggtagagggctagtttacagataaaatggttggtgtagatcatctagtttggaaaaagcaca

SEQ ID NO: 29590 - DNA, 201 bp, Homo sapiens
cctttgaatcttcagtgtttcaacatagacttgttacaaagagaaggaatataagcctctgttctttcttgtttccctttgttaattcctttttcctttcrttccttcttatctatccctttcttaccttctttatttcctcgtttatttgggctttttcggttgtgaagatcagtaccttgaaattcagaatagatggca

SEQ ID NO: 29591 - DNA, 201 bp, Homo sapiens
ggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgc

SEQ ID NO: 29592 - DNA, 201 bp, Homo sapiens
aaaagtgtagtggtttgtagggtcatccccctaaagatatcccgccccaccaaagatatccctaaagacatcctgctggtttcagtggctcatgcctgcawtcccagcactttgggaggctgaggcaggcggatcacttgagctcaggaattcgagaccagcctggccaacatggtgaaaccttatccgtaaaaaaaataa

SEQ ID NO: 29593 - DNA, 201 bp, Homo sapiens; identical to SEQ ID NO: 8537

SEQ ID NO: 29594 - DNA, 201 bp, Homo sapiens; identical to SEQ ID NO: 8538

SEQ ID NO: 29595 - DNA, 201 bp, Homo sapiens; identical to SEQ ID NO: 8539

SEQ ID NO: 29596 - DNA, 201 bp, Homo sapiens; identical to SEQ ID NO: 8540

SEQ ID NO: 29597 - DNA, 201 bp, Homo sapiens; identical to SEQ ID NO: 8541

SEQ ID NO: 29598 - DNA, 201 bp, Homo sapiens; identical to SEQ ID NO: 8542

SEQ ID NO: 29599 - DNA, 201 bp, Homo sapiens; identical to SEQ ID NO: 8543

SEQ ID NO: 29600 - DNA, 201 bp, Homo sapiens; identical to SEQ ID NO: 8544

SEQ ID NO: 29601 - DNA, 201 bp, Homo sapiens; identical to SEQ ID NO: 8545

SEQ ID NO: 29602 - DNA, 201 bp, Homo sapiens; identical to SEQ ID NO: 14775

SEQ ID NO: 29603 - DNA, 201 bp, Homo sapiens; identical to SEQ ID NO: 14776

SEQ ID NO: 29604 - DNA, 201 bp, Homo sapiens; identical to SEQ ID NO: 14777

SEQ ID NO: 29605 - DNA, 201 bp, Homo sapiens; identical to SEQ ID NO: 14778

SEQ ID NO: 29606 - DNA, 201 bp, Homo sapiens; identical to SEQ ID NO: 14779

SEQ ID NO: 29607 - DNA, 201 bp, Homo sapiens; identical to SEQ ID NO: 14780

SEQ ID NO: 29608 - DNA, 201 bp, Homo sapiens; identical to SEQ ID NO: 14781

SEQ ID NO: 29609 - DNA, 201 bp, Homo sapiens; identical to SEQ ID NO: 14782

SEQ ID NO: 29610 - DNA, 201 bp, Homo sapiens; identical to SEQ ID NO: 14783

SEQ ID NO: 29611 - DNA, 201 bp, Homo sapiens; identical to SEQ ID NO: 14784

SEQ ID NO: 29612 - DNA, 201 bp, Homo sapiens; identical to SEQ ID NO: 14785

SEQ ID NO: 29613 - DNA, 201 bp, Homo sapiens; identical to SEQ ID NO: 14786

SEQ ID NO: 29614 - DNA, 201 bp, Homo sapiens; identical to SEQ ID NO: 14787

SEQ ID NO: 29615 - DNA, 201 bp, Homo sapiens
ttgatgtgccttctcatttaatataagtaattattttaaaggttattgtgattaacatgtattccttatggaaaatttagaaagcgaagaaaaataaaaayaagaataaaagatttaaaaaaaccccaattcttaccagttagaagtatactattaatatttagcatgtatgattgtaagcatgttttcccttctttcgtg

SEQ ID NO: 29616 - DNA, 201 bp, Homo sapiens
attaatacctctgtttaaggttcattttgaacgccttggtgaccctatgtttttttctttgttttttgttttgttttttttttttttgttttttttttttktttttttgagatgaagtcttcctctgttgcccaggctggagtgcagtggcgcattcttggctcactgcaaccttcgcctcccaggttgaagcaattcttc

SEQ ID NO: 29617 - DNA, 201 bp, Homo sapiens
gtaatatttaagtattaatacctctgtttaaggttcattttgaacgccttggtgaccctatgtttttttctttgttttttgttttgttttttttttttttkttttttttttttgtttttttgagatgaagtcttcctctgttgcccaggctggagtgcagtggcgcattcttggctcactgcaaccttcgcctcccaggtt

SEQ ID NO: 29618 - DNA, 201 bp, Homo sapiens
gcttagatgaaatttaggcaaatggaatgccccaggccccaggaagactgtggcagcacattgtatgtaactgttggggatgttgcctgaaaccccccccytttttttaggcagctgcaaggattagaatgttgcctcctcagaaactaacactcttctctccttgacctttgtttaaccagctttctgaacctgaagaac

SEQ ID NO: 29619 - DNA, 201 bp, Homo sapiens
acagcttagatgaaatttaggcaaatggaatgccccaggccccaggaagactgtggcagcacattgtatgtaactgttggggatgttgcctgaaacccccsccttttttttaggcagctgcaaggattagaatgttgcctcctcagaaactaacactcttctctccttgacctttgtttaaccagctttctgaacctgaag

SEQ ID NO: 29620 - DNA, 201 bp, Homo sapiens
ttgtggcagagatcatctagctcgcaaaactgtaaatatttactctttggcctttcccagaaaaaagtgccgactgctatgttagatactccagttcattsaaagtgatatcaccctaacattctctaaattagccacagcttagatgaaatttaggcaaatggaatgccccaggccccaggaagactgtggcagcacatt

SEQ ID NO: 29621 - DNA, 201 bp, Homo sapiens
tttatataattgtcattgaagtcaaaactgatggcgtaatatttaaaacaatggctggatccccaatctaagaagaatacattttgttgatcatattaagyactgttacagtgaatgcatggacccatacaattgtggaataattaagaaaaaaggacttaagggcttaaaaatgtctttttaacaatttaacaagttagc

SEQ ID NO: 29622 - DNA, 201 bp, Homo sapiens
gctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacct

SEQ ID NO: 29623 - DNA, 201 bp, Homo sapiens
ttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccata

SEQ ID NO: 29624 - DNA, 201 bp, Homo sapiens
acccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgcta

SEQ ID NO: 29625 - DNA, 201 bp, Homo sapiens
aacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgct

SEQ ID NO: 29626 - DNA, 201 bp, Homo sapiens
agggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatca

SEQ ID NO: 29627 - DNA, 201 bp, Homo sapiens
tggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttc

SEQ ID NO: 29628 - DNA, 201 bp, Homo sapiens
tgaaggagaagcaggagttggtataccaatattcccactgtgccagcagagagcgggttatccttactagagagccagagagtcagaacggtttttttttkttttttttttttttttttgagatggagtttcacaattgttgcccaggctggagtgcacgatctcagctcaccgcagcctctgcctgccgggttgaagcaa

SEQ ID NO: 29629 - DNA, 201 bp, Homo sapiens
tcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcct

SEQ ID NO: 29630 - DNA, 201 bp, Homo sapiens
gtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcc

SEQ ID NO: 29631 - DNA, 201 bp, Homo sapiens
tgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagc

SEQ ID NO: 29632 - DNA, 201 bp, Homo sapiens
ctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctag

SEQ ID NO: 29633 - DNA, 201 bp, Homo sapiens
ccgtgaagtctagatctccctgctaacttacactgtgctcaaaacacacacacacacacacacacacacacacacacacacacacactggctgtcctcacygtcaactctagatctccctgctaacttacactgtgctcaaaaaacacacgcacgcacgcacgcatgcacgcacatacacacacacacacacacccatagg

SEQ ID NO: 29634 - DNA, 201 bp, Homo sapiens
ggactcgggtgcatacatggtttccaaacgcctttcctccagccctcccgactagtgtcttaaatctcaagctggcctctctggctccgctgtttttttttttttttttttttaatttaatttaactttaaattccgggatacatgtgcaggatgtgcaggtttgttacataagtaaacctgtgccatggtgacttgctgc

SEQ ID NO: 29635 - DNA, 201 bp, Homo sapiens
gcgtctcctcctttgccactcagccccagaggtgcttctgcttccctgcaggcttgccctggagcctggcgctagggccctggggctcccttgctcctgcktgccccctgcgcctgccttcctgctgcctggcctttctcccatctgctttcttcctgagtggcccctggccaggggactcgggtgcatacatggtttcca

SEQ ID NO: 29636 - DNA, 201 bp, Homo sapiens
tgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtgtct

SEQ ID NO: 29637 - DNA, 201 bp, Homo sapiens
ctgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtgtc

SEQ ID NO: 29638 - DNA, 201 bp, Homo sapiens
cctgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtgt

SEQ ID NO: 29639 - DNA, 201 bp, Homo sapiens
tcctgacctcgtgatcctcccgcctcggcctctcaaagtgctgggattacaggcgtgagctaccgctcccggcctttttttttttttttttttttttttttttttaaagacagggtctcgctccgtcgcccaaactggagtgccgtggtgcgatctcggctcactgcaacctctgcatgccgagttcaagcgattctcgtg

SEQ ID NO: 29640 - DNA, 201 bp, Homo sapiens
tgtgtttttagtagagacggggtttcaccgtgttagccaggatggtctcgatctcctgacctcgtgatcctcccgcctcggcctctcaaagtgctgggatyacaggcgtgagctaccgctcccggcctttttttttttttttttttttttttttttttaaagacagggtctcgctccgtcgcccaaactggagtgccgtgg

SEQ ID NO: 29641 - DNA, 201 bp, Homo sapiens
tttgagaaacatggatgtaaatctgattttcagcatctgggaaactttttttgtaagagcctttttctgggccccacttccagagggtttttctttttttkttttcttttgagacggagtcttgctctgtcgcccaggctggagtgcagcggcgcgatctcggctcactgcaacctccgcctcccgggttcacgccattct

SEQ ID NO: 29642 - DNA, 201 bp, Homo sapiens; identical to SEQ ID NO: 8546

SEQ ID NO: 29643 - DNA, 201 bp, Homo sapiens; identical to SEQ ID NO: 8547

SEQ ID NO: 29644 - DNA, 201 bp, Homo sapiens; identical to SEQ ID NO: 8548

SEQ ID NO: 29645 - DNA, 201 bp, Homo sapiens; identical to SEQ ID NO: 8549

SEQ ID NO: 29646 - DNA, 201 bp, Homo sapiens; identical to SEQ ID NO: 8550

SEQ ID NO: 29647 - DNA, 201 bp, Homo sapiens; identical to SEQ ID NO: 8551

SEQ ID NO: 29648 - DNA, 201 bp, Homo sapiens; identical to SEQ ID NO: 8552

SEQ ID NO: 29649 - DNA, 201 bp, Homo sapiens; identical to SEQ ID NO: 8553

SEQ ID NO: 29650 - DNA, 201 bp, Homo sapiens; identical to SEQ ID NO: 8554

SEQ ID NO: 29651 - DNA, 201 bp, Homo sapiens; identical to SEQ ID NO: 8555

SEQ ID NO: 29652 - DNA, 201 bp, Homo sapiens; identical to SEQ ID NO: 8556

SEQ ID NO: 29653 - DNA, 201 bp, Homo sapiens; identical to SEQ ID NO: 8557

SEQ ID NO: 29654 - DNA, 201 bp, Homo sapiens
tgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggct

SEQ ID NO: 29655 - DNA, 201 bp, Homo sapiens
aacttttgtagttgctgctggtctctttggaaggcaagtgctaatttacccacagttgaaacctgacacacacacgcgcgtgcacacacacagacacacastctctctctctttctctgtctctctctctttctctgtctctcataaggaactaaatcctgcgttttctcaccagagggctaatgacacactgcttagtca

SEQ ID NO: 29656 - DNA, 201 bp, Homo sapiens
tcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgtt

SEQ ID NO: 29657 - DNA, 201 bp, Homo sapiens
gacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtg

SEQ ID NO: 29658 - DNA, 201 bp, Homo sapiens
gaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaattt

SEQ ID NO: 29659 - DNA, 201 bp, Homo sapiens
ggaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaatt

SEQ ID NO: 29660 - DNA, 201 bp, Homo sapiens
aggaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaat

SEQ ID NO: 29661 - DNA, 201 bp, Homo sapiens
caggaggcggaggttgcagtgagcccagatcgcaccactgcactccagcctgggtgacagagcgagactccatctcaaacaaacaaacaaacaaacaaacaaactaagaacaacaacgaaaaaactcccatgtattatctatggattgactgtaaaatatgagaagcaataaatatgttcatcactagggccatctagaaa

SEQ ID NO: 29662 - DNA, 201 bp, Homo sapiens
ctgaggcaggagaatcacttgaacccaggaggcggaggttgcagtgagcccagatcgcaccactgcactccagcctgggtgacagagcgagactccatctmaaacaaacaaacaaacaaacaaacaaactaagaacaacaacgaaaaaactcccatgtattatctatggattgactgtaaaatatgagaagcaataaatat

SEQ ID NO: 29663 - DNA, 201 bp, Homo sapiens
cgaacatacatgttgaaaatttcaaaagggaaaaaagaaaagaaaggcacatctgagtcaggaaaacattaactagtcttatttctgagaatcaaaccggkggtcttttcagtgatcagtcaccccattaaccacacatgaatggcacaagtaggaaatgcctgctcagagtccctggaagaggtatccagatttatggct

SEQ ID NO: 29664 - DNA, 201 bp, Homo sapiens
aacccagtaggcggaggttgcagtgagccgagatcgcaccactgcactccagcctaggtgacagagtgagactccgtctcaaaaaaaaaaaaaaaaaaaaagaaagaaaacaaaaacaaataggacccatatccctggattgttgaggaaatacgtgaacatatgtggcacacattatagtgtctggcatacaataaatac

SEQ ID NO: 29665 - DNA, 201 bp, Homo sapiens; identical to SEQ ID NO: 8558

SEQ ID NO: 29666 - DNA, 201 bp, Homo sapiens
tatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaa

SEQ ID NO: 29667 - DNA, 201 bp, Homo sapiens
ccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagca

SEQ ID NO: 29668 - DNA, 201 bp, Homo sapiens
attcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctgg

SEQ ID NO: 29669 - DNA, 201 bp, Homo sapiens
ggaatttattttaaattacagctttttctattggaagcattcatttatgttggattattgttccctgagtgaaatttcactgatgctgtataattaaatayagatttttttagagatagtatatattttagatgtataagtggataaactggaggtatggaaggtctttatttaaggagaataaatagcccaccccatcaa

SEQ ID NO: 29670 - DNA, 201 bp, Homo sapiens
atgttagggctagcaggtaaacccagctgcaccccagagcaggtgtatacatgagtgctagtgggtaaatccagcagacgtccggactgtgcttgagggtrtcatcgagagagagaaggttgatccgaagttagtaaaggctttaaaaattaaaaggcctgagatgatggtagggttttggaggtaagtataaaaaccttc

SEQ ID NO: 29671 - DNA, 201 bp, Homo sapiens
cgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagtt

SEQ ID NO: 29672 - DNA, 201 bp, Homo sapiens
ccttgaacctgggaggcagaggttgcagtgagccaaggtggtgccactgcattccagcctgggcgacagagcgagattccgtctcaaaaaaaaaaaaaaaagtaatcattttagaattgctttctcttcgggatggtttacctcgtgtttagtctgtaaacgcggataaccgagagctggtcaaatgtttacatggggctg

SEQ ID NO: 29673 - DNA, 201 bp, Homo sapiens
aggccactgcactccaatctgggtgacagagcaagactctgtctcaaaaataatagtaataataataataataataataataataataataataataagaatctgactaaggttattaaccattaaggtatgctgtgctaaggagcagggggccccttccatccgtagagggcagaaaggtgcctatcatgtcttcagtgt

SEQ ID NO: 29674 - DNA, 201 bp, Homo sapiens
caggccactgcactccaatctgggtgacagagcaagactctgtctcaaaaataatagtaataataataataataataataataataataataataataagaatctgactaaggttattaaccattaaggtatgctgtgctaaggagcagggggccccttccatccgtagagggcagaaaggtgcctatcatgtcttcagtg

SEQ ID NO: 29675 - DNA, 201 bp, Homo sapiens
tcaggccactgcactccaatctgggtgacagagcaagactctgtctcaaaaataatagtaataataataataataataataataataataataataataakaatctgactaaggttattaaccattaaggtatgctgtgctaaggagcagggggccccttccatccgtagagggcagaaaggtgcctatcatgtcttcagt

SEQ ID NO: 29676 - DNA, 201 bp, Homo sapiens
agatcaggccactgcactccaatctgggtgacagagcaagactctgtctcaaaaataatagtaataataataataataataataataataataataataakaagaatctgactaaggttattaaccattaaggtatgctgtgctaaggagcagggggccccttccatccgtagagggcagaaaggtgcctatcatgtcttc

SEQ ID NO: 29677 - DNA, 201 bp, Homo sapiens
acctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacag

SEQ ID NO: 29678 - DNA, 201 bp, Homo sapiens
gacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattaca

SEQ ID NO: 29679 - DNA, 201 bp, Homo sapiens
tgactttaacattattttcagatagggagcactcagtaccaaccattatattaggctcatgggctcaacattttgctgtgcttttcatagatactgacacytgtgttttcattttgttgttgttgttgttttccctgccgggaaactgccgcatcctgtgttttcatggcatgatattaaggaacgatgggtaggatgctg

SEQ ID NO: 29680 - DNA, 201 bp, Homo sapiens
cttaacttctttaaacctcagtttcttcatctgtaaaatgcacatcataatatctctattcagagatacaggtggttctattaaacacatcaactctgtgkatataaagtcttaacccattgtggaataaattaagtgctcaattaaatgttagctgctgctattaataacaacaataataatattttcttcacgcatgaa

SEQ ID NO: 29681 - DNA, 201 bp, Homo sapiens; identical to SEQ ID NO: 14788

SEQ ID NO: 29682 - DNA, 201 bp, Homo sapiens; identical to SEQ ID NO: 14789

SEQ ID NO: 29683 - DNA, 201 bp, Homo sapiens; identical to SEQ ID NO: 14790

SEQ ID NO: 29684 - DNA, 201 bp, Homo sapiens; identical to SEQ ID NO: 14791

SEQ ID NO: 29685 - DNA, 201 bp, Homo sapiens; identical to SEQ ID NO: 14792

SEQ ID NO: 29686 - DNA, 201 bp, Homo sapiens
ttttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaa

SEQ ID NO: 29687 - DNA, 201 bp, Homo sapiens
tgcctctctttccttagtcctgtgtgcttccccttgatttcaccaggacaattttataccaatcccttgtattttagaagagcctgatacatttgcaaggwctctctttatattcctgaattttgcatccctagacatcatcctttttgagagagaaaattccgagtgtcagttttcctttatcggaacctccttttattt

SEQ ID NO: 29688 - DNA, 201 bp, Homo sapiens
atgcagtgttttccctgcaaaggagaagaaatatatttcttgcctctctttccttagtcctgtgtgcttccccttgatttcaccaggacaattttataccmatcccttgtattttagaagagcctgatacatttgcaaggtctctctttatattcctgaattttgcatccctagacatcatcctttttgagagagaaaatt

SEQ ID NO: 29689 - DNA, 201 bp, Homo sapiens
atgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctcttt

SEQ ID NO: 29690 - DNA, 201 bp, Homo sapiens
aagcaattgtggtttttgccattaaaagtaatagtaataataatactcggttggtgcaaaagtaaatgtgttttttgctattaaaagtaatgcggttttasttctgcagtttttttgccatttgccaattacttttgcagtttttgccagtacttaaaagtaatggcaaaaactgcaaaagtaattggcaaatggcaattg

SEQ ID NO: 29691 - DNA, 201 bp, Homo sapiens
ttaagattaaattattgatactgaaatattaggttgtgcaaaagcaattgtggtttttgccattaaaagtaatagtaataataatactcggttggtgcaawagtaaatgtgttttttgctattaaaagtaatgcggttttacttctgcagtttttttgccatttgccaattacttttgcagtttttgccagtacttaaaag

SEQ ID NO: 29692 - DNA, 201 bp, Homo sapiens
gcatttggctgcacagcaagttctaagttactcaccaggtttcagaggagagatgggaatttgatgatcttataagaaacctgtactctttggccagacayggtggctcatgcctgtcattccagcactttgggagaccaaggcgggcagatcacctgaggtcatgagttcgagaccagcctgggcaacatgctgaaaccc

SEQ ID NO: 29693 - DNA, 201 bp, Homo sapiens
agcctcccaaagtgctgggattacaggcgtgagccaccgtgcccagccttcttgttttaatcttttagacaactggacacaggtttgtctttgaaattgtmctggtttttcttgatgttttagtgctcctggatgtccaatgtcattcttgggctagttgaaggaaagttttggctacccagttgttagctgctgaagttt

SEQ ID NO: 29694 - DNA, 201 bp, Homo sapiens
cagagtcttgctctgttgtctaggctggagtgcagtggcaccatctcggctcaccacgagctctgcgtcgtgggttcatgccattctcctgcctcagcctscggagtagctgggactacaggcactcaccaccatgcctggctaattttttgtattttttagtaaagatggggtttcaccatgttagccaggatggtctcg

SEQ ID NO: 29695 - DNA, 201 bp, Homo sapiens
atttccattttacttctatttggtagtctcagaacttggcttttattggccagtatattcaatgattcacttgcacctttaaccttgtgttgttctaatcyttttttttttttttttttttttttttttttttttgagacagagtcttgctctgttgtctaggctggagtgcagtggcaccatctcggctcaccacgagct

SEQ ID NO: 29696 - DNA, 201 bp, Homo sapiens
atccaactcaaaggctgttgaaaggctccttctgtttaaggtaaagcctgtggcagcctttaacttcctttctcttctcctgctgccaccttggtccacartttatctttgaaaatgctgggttttaatgggcagggtatagtgcagaaaccagatggttttaactcacacctgtgaaaatgctggggatctgcgaaacat

SEQ ID NO: 29697 - DNA, 201 bp, Homo sapiens
gtcactacgtattgcgtatatttggttggaattttatttttgagcaattcatttacccagattgtgtttctggagattaaagcatctcactgtatttttakttttttctacattgcaatttcaaaataatccaactcaaaggctgttgaaaggctccttctgtttaaggtaaagcctgtggcagcctttaacttcctttct

SEQ ID NO: 29698 - DNA, 201 bp, Homo sapiens
tatggatttcttcctcagtttatttcttctttgattttttcatgtccaggtcactacgtattgcgtatatttggttggaattttatttttgagcaattcayttacccagattgtgtttctggagattaaagcatctcactgtatttttatttttttctacattgcaatttcaaaataatccaactcaaaggctgttgaaag

SEQ ID NO: 29699 - DNA, 201 bp, Homo sapiens
agaagtttctgtatcaactggaaaaaaccatggtgcttgggacattcaaggccgaaacttggtccctggatgggagaagatagctgtatcattggcagagstgccttggtcatgtaccctctccagactagacactagatagtgggtagggtgggacagttttatgtcctctgccaccttatctgggactcttgtcccctg

SEQ ID NO: 29700 - DNA, 201 bp, Homo sapiens
aagtaacagaaccataggccttatctttatctgagttcctgtagcatgtgcactactcctgattaaccaagtgaaagagaaaatgagactaatctctaacstcagcttccttttctgccaaatggaagatcatctctaattaataatgagttagaatacctaggacagtatttggcacacagttgatgaggatggtgtacc

SEQ ID NO: 29701 - DNA, 201 bp, Homo sapiens
ctcctgctgtgatgccacttctaatctcaattttattatacaatttgttaaatacagaagtaaatggaggcaatagtgatagtaaaaagaaccatgtgaaytgggcgtggtggctcatgtctgtaaagccagcacttcgggagtccaaggtaggagggtcacttgagcccagcaattggagaccagcctgggcaacatcat

SEQ ID NO: 29702 - DNA, 201 bp, Homo sapiens
ctcctatcccctttcagctcctgctgtgatgccacttctaatctcaattttattatacaatttgttaaatacagaagtaaatggaggcaatagtgatagtraaaagaaccatgtgaactgggcgtggtggctcatgtctgtaaagccagcacttcgggagtccaaggtaggagggtcacttgagcccagcaattggagacc

SEQ ID NO: 29703 - DNA, 201 bp, Homo sapiens
cttgaacctgggagtcggaggttgcagtaagctgagatcgccactgcactccagcctgggcaacagagcaagacgccatctcaaaaaaaaaaaaaaaaaaagtgtaatgcaagtagaaaagggcacacactccaggtgtatatctcaacaaatttgtacacactgcatgcacatgggtgacccgcacccacatgttataca

SEQ ID NO: 29704 - DNA, 201 bp, Homo sapiens
cttccacatacaaagtctgggacacagtacgctctcataagagacctcttctcaacaggatccatgtttgatccgggggaataaagctagagttgctttcwtccttgtaatatgtataatgactcatgagagaattccccactgtcttccccacctgagacctgagaggaggagaaggaagcttggagtcgctgccctgtg

SEQ ID NO: 29705 - DNA, 201 bp, Homo sapiens
gcttccacatacaaagtctgggacacagtacgctctcataagagacctcttctcaacaggatccatgtttgatccgggggaataaagctagagttgctttmttccttgtaatatgtataatgactcatgagagaattccccactgtcttccccacctgagacctgagaggaggagaaggaagcttggagtcgctgccctgt

SEQ ID NO: 29706 - DNA, 201 bp, Homo sapiens
gagcttgttttattttgcttgggctgctgtagaaataccacaggtcaggtggcttaaacaacaggaatgtagttcctcacagttctggaggttgggagtcmtagatcaaggtgtcagcagggttggtttctctctgtaccattgtccctggcttggagatgaccatcttctctgtcttcacatggtcttccctctgtgtgc

SEQ ID NO: 29707 - DNA, 201 bp, Homo sapiens
aaatgccatggactgaataatatataaacaacggaaatgtatttctcacaattccggaggctgagaagtccaagaggaaggcactggcagattcagtgtcyggtgaggatttgtttttgatctcataggtgtccatcttgctattttctcaactagcagaggcaactctctggggtatcttttaaaagggcactaatggcc

SEQ ID NO: 29708 - DNA, 201 bp, Homo sapiens
gaagaaatgctgttttaggaaatcaataggataatttttttttttttttgaggcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattt

SEQ ID NO: 29709 - DNA, 201 bp, Homo sapiens
ataaataaatacataataaataaacagtagtggttgaaagaaagggaaggaagaaatgctgttttaggaaatcaataggataatttttttttttttttgargcggagtctcactctgttgcccaggctggagtgcagtggcacagtctcggctcactgtaagctccgcctcccgagttcacgccattctcctgcctcagcc

SEQ ID NO: 29710 - DNA, 201 bp, Homo sapiens
ttctctcattccattggctgaagcaaatcatgtatacaagccagaagccaatgagctataggaagggtagcaaagaacagaacagccatacagcctagccsacagatggggtcaagaagattcaataggcattggctgaagacttaagacttctcaagcaagttggatcctggtgtgcacctggcatatcctttaggattc

SEQ ID NO: 29711 - DNA, 201 bp, Homo sapiens
acgcaattagataatacaaaaataacaaaactataggaggttgaggatggggctgggggccaaggagattacttggtttgaaatgaataaattgtctatcstaagggaattctttggtgcattttattgtgtgaaatgagcctggtcatatgactgccctgcctccctggaggcctccctgccctcctccttcccacagac

SEQ ID NO: 29712 - DNA, 201 bp, Homo sapiens
tccttctcatatgtttaggcaagcgttgatgacatcaacctagccttttattttaaatcccctgtcaacgcaattagataatacaaaaataacaaaactayaggaggttgaggatggggctgggggccaaggagattacttggtttgaaatgaataaattgtctatcgtaagggaattctttggtgcattttattgtgtga

SEQ ID NO: 29713 - DNA, 201 bp, Homo sapiens
ttgtatttacaaatgtggcattaagtagaacaacgtattcttgcaattaatgacaggaagcctacaatttctcattaagcacaggacagtgagaacgaacrgaatttcagagacatgtttcttaacattaaaaacaacaaaaacaacaacaacaacaaaaaaccaagtaggaagcaggcagagttgcaatatgaagaacaa

SEQ ID NO: 29714 - DNA, 201 bp, Homo sapiens
tttaaagcgatagtcctattttctaagtaaaagtccaggcatgtgacttaaaaaagaaaaaaaaaaatgttttctggtcaagtcacatgcctctgaggttkttttttttctttctttcttttctttttttttctttttcccagactcctcatacccctcctaggagacagtgattccctggcttcaccaggcaggctcttg

SEQ ID NO: 29715 - DNA, 201 bp, Homo sapiens
tgagagtgcctgaaacccagagaggtcgtacgttgaccatgccacggggcccttcctggtaaatctaagcagaaatacaccatgcatgagacagaacaaaraaaagaactgtgaaaatacactcaggaccaggatgctgatacagtcatgaggttcagcttaaaaggccagtttctctactgcagaataatgaggtctatc

SEQ ID NO: 29716 - DNA, 201 bp, Homo sapiens
cagctggcgtaagaggagtgactcatttgttcttctttttttttttttttttggctgtctacagagaaggaggatataggggcccttaagagaaaaactgkagtagggtgtgtgtgtgtttgttttggtcaagggcagagtgtgctgtgtcagggtgtttcattgcattttcatatttgtcatttctctttggagcgtgtc

SEQ ID NO: 29717 - DNA, 201 bp, Homo sapiens
ttgaagacacaaattcagatgcatgtggatgggcccaaaatactttgtttacatgtactccaaatgtaactcctggggcacccttccttattttctctacsacaccaatgccttcatggtcttacatcttgtcctcttaaccctgacttctctagccctcatgaatgctttagtgtggcagatgttactgtacatgggccc

SEQ ID NO: 29718 - DNA, 201 bp, Homo sapiens
aacccttctactacaagacatagaagaaaattagttggccatggtggcacacacctatagtcccagctactaaggaggctgaggcggtaggatcgcttgakcccgggaggtggaggctgcagtgagctgtgatcacgccactgaattctagcctgggtgaccgagaccttgtctaaaaaataaataaataaataaaattag

SEQ ID NO: 29719 - DNA, 201 bp, Homo sapiens
cttgaggccaggagttcgagaccagcctggccaacatggtgaaaccccatctcacctaaaaataaaaaattagctgggcgtggtggcagccacctgtagtmccagctactcaggagactgaggcaggagaatcgcttgaacccaggaggaggaggttgcagtgaactaagattgtgccactgcactccaacctgggcaaca

SEQ ID NO: 29720 - DNA, 201 bp, Homo sapiens
cggattacttgaggccaggagttcgagaccagcctggccaacatggtgaaaccccatctcacctaaaaataaaaaattagctgggcgtggtggcagccacytgtagtcccagctactcaggagactgaggcaggagaatcgcttgaacccaggaggaggaggttgcagtgaactaagattgtgccactgcactccaacctg

SEQ ID NO: 29721 - DNA, 201 bp, Homo sapiens
tcaggtggtgactggaggagccagaaggtccctttgggcctgtcctctcaccagcatcaactgcaccaaaaagatctcattctgattatcagggatgaacscccccactgggtgatcaggcaaactacatgcattttaaaaaactatatcctgctgggtgcagtgcctcatgcctgcaatcccagcattttgggaggttga

SEQ ID NO: 29722 - DNA, 201 bp, Homo sapiens
taactgcaatcagatgttttatttgtttatttatttttccttcttgcgttgctcttaagcccccactcttgggcaaggctctgtgctatgctgttttatgsacatcatcttctaacagcttctctgccacacctggagaagtgccaatatcattttcatggcacagataaggcattggatgctcatagtttaagtcatcag

SEQ ID NO: 29723 - DNA, 201 bp, Homo sapiens
tttatatttttagtggagacggggtttcactatattggccaggctgatctcgaactcctgcccttgtgatccacccacctcggcctctcaaagtgctgggmttacaggtgctagccaccacacccggcctcttctcgatagatcttatttggctgacaacgaaagctgttgtgctggtagcatcatccctttgcatgcaaa

SEQ ID NO: 29724 - DNA, 201 bp, Homo sapiens
ggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagt

SEQ ID NO: 29725 - DNA, 201 bp, Homo sapiens
tggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatag

SEQ ID NO: 29726 - DNA, 201 bp, Homo sapiens
atggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaata

SEQ ID NO: 29727 - DNA, 201 bp, Homo sapiens
agagtggaatattcataatcagcagaagtcttttctctggaaggaacaaaggattaagttagggagacagtaatggtattgttagcaggctatttcaatgrttttctctgcggaagagtagggaaaggtgacattccaactgggaatattcgactctgcagatccctactcggagtttttcagccctgttttaagtgccga

SEQ ID NO: 29728 - DNA, 201 bp, Homo sapiens
ctcgttcagtttccacataatacctggggcagggatgtaaataccctgattttatgtgtcaggccttcaggactcagggtgtataagtgacatggctcctsgcacagcagggatggagaggcaaacccaggttggcctctctgccactcatatagaactcctttatcaccaagattcctttcttcttcagtgccacctgcc

SEQ ID NO: 29729 - DNA, 201 bp, Homo sapiens
cactgtgcaggtgactcacgcctagaatcctctgcctatcgtgacagggagaagcctgtgtgaccctgtggccatctcagtctctgcagggcatctgtagytttggaggtacctgggcaagagactgcctttcctactagagcttctgccatccctctgtcactatttaaagcattgcctgcaccctcaacctcgttcagt

SEQ ID NO: 29730 - DNA, 201 bp, Homo sapiens
agcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggcccc

SEQ ID NO: 29731 - DNA, 201 bp, Homo sapiens
cagacattgaactgaatctccaccttgggcttgagactctgcaaagtgcattaaatgggaaggaaaccaaagggcctgctgccctgcccccgccatagccyaaggctgtggccatggctggggaattggcctgtcagttcaatcaggcagcccctctgactggtgtttttcactaagctggccccatggatggccctggtc

SEQ ID NO: 29732 - DNA, 201 bp, Homo sapiens
catgtcaggaaggtgtccgatcagaacctgaatgccagctcaagctgctctcagctaaactccaggggttgctgatggagacttcatcccctcctccagtyccgggatcaagacagaaatgtaaatcacctccaagaatgggtctgcgtcttgcacattttccttttgagaaagaggaaaattctcagctggtctagcttt

SEQ ID NO: 29733 - DNA, 201 bp, Homo sapiens
cactgttctaaacacatgacaccaatagctcactcagattcccgcctctcaacagggaaactgaagcacaggaagtttcagtgatgcacttaggcaaccaktaagtggcagggtcggcattgaggtcaagactggttggacccctaagtttgaacaatcaaactggactttggggctcacagtttgtttcatgtcaggaag

SEQ ID NO: 29734 - DNA, 201 bp, Homo sapiens
gccagtgactacagtgtgcctggaaaggtcactggaggcatttttgtctggggcagcccctggagtcttggcttttgtgcttggtgagaccttatctggcytcttcattgtccccttcatacaaatagatagcttttagtgagcagctactctgcctggcactgttctaaacacatgacaccaatagctcactcagattcc

SEQ ID NO: 29735 - DNA, 201 bp, Homo sapiens
gcaaacgttttgaaaagaaatctcctttcaaaaatcacagcactggttgaagcaggagcatctctccccttaaatgcaaaaggagttaatatgccagtgaytacagtgtgcctggaaaggtcactggaggcatttttgtctggggcagcccctggagtcttggcttttgtgcttggtgagaccttatctggcctcttcatt

SEQ ID NO: 29736 - DNA, 201 bp, Homo sapiens
agttgggggagagattttgaccaggcaggctctcaggtcggtgccatcggtgacgccaacacacctcctggcttggtgtgttttgtggcatttggcaggcmaacgttttgaaaagaaatctcctttcaaaaatcacagcactggttgaagcaggagcatctctccccttaaatgcaaaaggagttaatatgccagtgacta

SEQ ID NO: 29737 - DNA, 201 bp, Homo sapiens
gaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctggagtagacaactagttcatggtaacaggaccagcagagctccgtcttgatgct

SEQ ID NO: 29738 - DNA, 201 bp, Homo sapiens
aaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtt

SEQ ID NO: 29739 - DNA, 201 bp, Homo sapiens
ctcatagttttcaggtggcataagccatggcattttcacctcctttcctggttgtttccagaaagggatgatagccccagtgcagtggctctgtatttctyagggcagcgtgggacctcagggtttgtcatggaccacacctttctcctttgtccctttttataactcataggctacctccaacttgacacttatttaagt

SEQ ID NO: 29740 - DNA, 201 bp, Homo sapiens
aaatcccacatgaaaagtctcaatcacctggctcaaactcatagttttcaggtggcataagccatggcattttcacctcctttcctggttgtttccagaargggatgatagccccagtgcagtggctctgtatttctcagggcagcgtgggacctcagggtttgtcatggaccacacctttctcctttgtccctttttata

SEQ ID NO: 29741 - DNA, 201 bp, Homo sapiens
ttcaggattgatcacaaaatcaaaaccattcctaccagccagaggtgggcacatgacccaggtcagaccagtcacagttcctgattcccggccacagtgcwtgatgggggaatgagcatatatcaaaccaggacagtccaagtccttccggggactttgctgccacagttgacagggggaggtatttgcataacttcacca

SEQ ID NO: 29742 - DNA, 201 bp, Homo sapiens
gacctcccaggctcaacctatcctcttacctcagcctcttgagtggctggaaccacaagcagatgccaccatgcctggctaactttttttttttttttttktttttgtagaaacagagtctctctatgttgcccaggcttgtcttgtactgggctcaagcaatcctcccatcttggcctcccacagtattgggattacagg

SEQ ID NO: 29743 - DNA, 201 bp, Homo sapiens
aaaacctgaacctaaaaagaaattctttagccatgtccgtgtgaactaaattcagcgtcagatgtacaaggctgtggttctgaccacccccgggctatttytgaccacaggacagcttaaatggtgtggcccataaaatgtaatctgcaaactcaggctgaatgttgatctatttagggccaagagaagaccaggccttgg

SEQ ID NO: 29744 - DNA, 201 bp, Homo sapiens
ttgctgaaggtccccagcctccttgctcccaaacacttcaagaaggaaaatgctgttgcagaaatgttgtctaagctttaccattcagtgtggcccagatmaacctgtcccttctttttgtgatcacagtgtgtaattataaagttatttgtgtgtttggtttatgtcttccacactggactgtaagatccatgagatcta

SEQ ID NO: 29745 - DNA, 201 bp, Homo sapiens
aaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaa

SEQ ID NO: 29746 - DNA, 201 bp, Homo sapiens
aaaaattcggatgcattttgcacagaattaagacgttatgtgcaatccttgtgtttctaattatatgttgatcaatgacacctttacaaaactgtcatcartctattggtggttgattggtccaaccttagcccgatacctctatctccgcttagtcattcctggtgggtgactgatgacccctgcttaacagtaaacttg

SEQ ID NO: 29747 - DNA, 201 bp, Homo sapiens
cgcccaccaccatgcctggctaattttatgtatttttaatagagacagggtttcaccatgttatcaggatggtctcaatctcctggcctcgtgattcaccygccttggcctcccaaagtgctgggattacaggcgtgagccaccgcggctggcgaaaattatatattatacacacaaacatacacacacgcacacaccaaa

SEQ ID NO: 29748 - DNA, 201 bp, Homo sapiens
accactggattagtctcttgcctttcaattttatgtttatatacaaatatatgtgcataccaaattttatatatatatatatatatatatatatatatttwtttttttttttttttttttttttggtcggagtctcaccctttcacccaggctggagtgcagtggcgcaatctcggctcactgcaagctccgcctcccggg

SEQ ID NO: 29749 - DNA, 201 bp, Homo sapiens
tcataccactggattagtctcttgcctttcaattttatgtttatatacaaatatatgtgcataccaaattttatatatatatatatatatatatatatatwtttttttttttttttttttttttttttggtcggagtctcaccctttcacccaggctggagtgcagtggcgcaatctcggctcactgcaagctccgcctcc

SEQ ID NO: 29750 - DNA, 201 bp, Homo sapiens
tgttgatgcttttttgcctttttgacaattaaaaataatctcataccactggattagtctcttgcctttcaattttatgtttatatacaaatatatgtgcmtaccaaattttatatatatatatatatatatatatatatatttttttttttttttttttttttttttggtcggagtctcaccctttcacccaggctggag

SEQ ID NO: 29751 - DNA, 201 bp, Homo sapiens
ggtgtaaattagtcaccagtgtctcatagggttgggctgaaacttaacacatcccatcactttgattggctaaagtcagttacataaccaagcccagcttyagaagggaaattgtatgccttacaaggaggtgagaggatggaaaatgaatatttgctgaacagactttctgtccagtttgttgtatttggtggtggtgca

SEQ ID NO: 29752 - DNA, 201 bp, Homo sapiens
cagaactcacaaaatgtccagctttctttcttttattcaaaatttatacttcataattgaagttcacctcccaaaagacatagcttggtttagcatagagytatgatgtgttttctctttgttccttttgcacactttccttgtctggaggcgttgggcttggatccttcattcttcatgaggctgatgtttttccatttc

SEQ ID NO: 29753 - DNA, 201 bp, Homo sapiens
ttacaccctgtgatttgaattttccatactccattccattctatatgtcagatgcatcttcctaaaacacacctttgtcacatcactcctctgctcaaaarcattcagtggctccctgggccctctgggactaagtttataatgctcagcttgtcattcctttgcccagtgtactctctgtctcactaatttgttcattat

SEQ ID NO: 29754 - DNA, 201 bp, Homo sapiens
ataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaatt

SEQ ID NO: 29755 - DNA, 201 bp, Homo sapiens
gcaagaatttatcccttctgttgatgcaattaaagctaatggatctcatatatatatatatatatatatatatatatatatatatatatatatatatatatttatataaatatattttatatttaaaaatatttatattttatatatttttatatatttatgcaagtatatatctaaatatataaaatatatataaatata

SEQ ID NO: 29756 - DNA, 201 bp, Homo sapiens
tgcaagaatttatcccttctgttgatgcaattaaagctaatggatctcatatatatatatatatatatatatatatatatatatatatatatatatatatatttatataaatatattttatatttaaaaatatttatattttatatatttttatatatttatgcaagtatatatctaaatatataaaatatatataaatat

SEQ ID NO: 29757 - DNA, 201 bp, Homo sapiens
aaaaagcttccaactttttttttttttttttttgagttggagtcgcactctttcacccaggctggagtgcagtggcccgatcctgggtcactgcaacctcygcctcctggattcaagcgagtttcctgccttagcctcccgagtagctgggattacaggcacccgccgccacacccagctgatttttgtattttagtagag

SEQ ID NO: 29758 - DNA, 201 bp, Homo sapiens
tcatcctctgaaaaactcttctgaacaacatcggctgtgcatagtaactgccttgagtggggccattttagaaaatatatgaggtacgggatgaagatgasggaggaaaatggttcctacttatcattactttgtccctccaaaagcctgcatgcgggaagaaaaatccacccagtgcaagaaccgtggcagtactcagac

SEQ ID NO: 29759 - DNA, 201 bp, Homo sapiens
gataccaataattaatatctatggttgattgtaaaaatggccaccaattcttccctgtcccctgcatatgtacatccttgcactgtgaaattgtagatctygccctccaaaggtgaagttcgtttgtccactccttgaaccaggatggcatgaaacttgatttgaccaatgaggcatttggaaacacggcacaagcaaagg

SEQ ID NO: 29760 - DNA, 201 bp, Homo sapiens
aggtagatttttagaaccaaatgccttttaggaagctacctctcttccaccctgctgcctttgtgttgaataaactatattaaattatccaggaggaatgrttagtgatctgattcattaatatcccttgttattaagaactgtctgtatttgtgtcctggttggcagatattaagtccacagataccaataattaatatc

SEQ ID NO: 29761 - DNA, 201 bp, Homo sapiens
catttgcaaaacactttgacaatactttcctttcagtctattttcctgtgtatggggtaagtgttgcccttctgcaactttccttttattttatttatttmtttcttttcaatactctgaatatcactggagcagctgcagattcagggcagtatggggtggttcaggaacagaactgacaggtattgaagccaaaaattg

SEQ ID NO: 29762 - DNA, 201 bp, Homo sapiens
tttatattgctgaaaatgtcatttgcaaaacactttgacaatactttcctttcagtctattttcctgtgtatggggtaagtgttgcccttctgcaactttmcttttattttatttatttatttcttttcaatactctgaatatcactggagcagctgcagattcagggcagtatggggtggttcaggaacagaactgacag

SEQ ID NO: 29763 - DNA, 201 bp, Homo sapiens
ggcggtgcatgcctgtaatcccagctacttgggaggctgaggcaggagaatcccttgaacctgggaggtggaggttgcagtgagctgagatcacgccattrtactccagtctaggcaacaagagtgaaactctgtctcaaaaaaattaataataataatgttacaataataataatgttagtgatacatatcattttgaaa

SEQ ID NO: 29764 - DNA, 201 bp, Homo sapiens
agagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctac

SEQ ID NO: 29765 - DNA, 201 bp, Homo sapiens
ctgcaaactacccccgcccccgggttcaagcaattgtcgcacctcagcctcccaagtaactgggattacaggtgcccaccaccaagcccggctaatttttstattttcaatagagatgaggttttgccatattggtcaggctggtcttgaactcttgacctcaggtgattcacccacctcagcctcccaaagtgcagggat

SEQ ID NO: 29766 - DNA, 201 bp, Homo sapiens
ggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggc

SEQ ID NO: 29767 - DNA, 201 bp, Homo sapiens
aggcggagcttgcagtgagccgagagcccgccactgtactccagcctgggcgacagagcgagactccgtctcaaaaaaaaaaaaaaaaaaaaaaaaaaaaagacacgtacacagacaaatgttctgacagaaatacactgagatatctacagtgcttgtctctggataggatagggtataatttaattgtttatagttaag

SEQ ID NO: 29768 - DNA, 201 bp, Homo sapiens
gtggcgggcacctgtagtcccagctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaagacacgtacacagacaaatgttctgacagaaataca

SEQ ID NO: 29769 - DNA, 201 bp, Homo sapiens
gtcaggagatcgagaccatcccggctaaaacggtgaaaccccgtctctactaaaaatacaaaaaattagccgggcgtagtggcgggcacctgtagtcccarctacttgggaggctgaggcaggagaatggcgtgaacccgggaggcggagcttgcagtgagccgagagcccgccactgtactccagcctgggcgacagagc

SEQ ID NO: 29770 - DNA, 201 bp, Homo sapiens
acgaggtcaggagatcgagaccatcccggctaaaacggtgaaaccccgtctctactaaaaatacaaaaaattagccgggcgtagtggcgggcacctgtagkcccagctacttgggaggctgaggcaggagaatggcgtgaacccgggaggcggagcttgcagtgagccgagagcccgccactgtactccagcctgggcgac

SEQ ID NO: 29771 - DNA, 201 bp, Homo sapiens
agcaatttacaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccg

SEQ ID NO: 29772 - DNA, 201 bp, Homo sapiens
aatacaggcctttcccatttcacagtgtttctagctcccctttccaatacatctctctctctctttctctctctctctctctctctctcacacacacacacacacacacacacacacagccaaatcagacaccaacataaactgtagagttaacattctttttccaccctcacactttttttagctccgatctgtgttcaa

SEQ ID NO: 29773 - DNA, 201 bp, Homo sapiens
taaatacaggcctttcccatttcacagtgtttctagctcccctttccaatacatctctctctctctttctctctctctctctctctctctcacacacacacacacacacacacacacacagccaaatcagacaccaacataaactgtagagttaacattctttttccaccctcacactttttttagctccgatctgtgttc

SEQ ID NO: 29774 - DNA, 201 bp, Homo sapiens
aaaaccacacttacatttaaatacaggcctttcccatttcacagtgtttctagctcccctttccaatacatctctctctctctttctctctctctctctcwctctctcacacacacacacacacacacacacacacagccaaatcagacaccaacataaactgtagagttaacattctttttccaccctcacacttttttt

SEQ ID NO: 29775 - DNA, 201 bp, Homo sapiens
tttggcagttacctgaaagaaaatttagtgattgccagtccattctctagccttctgaagaagatagattgtaatctttaattaagctatcactcacaccmaaaaaaaaaaaaaaaaaaaaaaaaaagcggggcaaggggttggagaatgttcatatcacattattttggatgtctggggttgcacctggaagctcagata

SEQ ID NO: 29776 - DNA, 201 bp, Homo sapiens
cattgtcccccaccttattctaaataatgactttcttaaaactacatgttttgggggaatgtcctgcaatattgctttacatctttttatttttttatttyattttattttttttgagacagagtctctgtctccaggctggagtgcagtggcacaatctcagctcactgcaacctccacctcccgggttcaagcgattcc

SEQ ID NO: 29777 - DNA, 201 bp, Homo sapiens
gaattgtctttggctgcacataatatacaattgttgatgagctaaaaaaaaaaaaatccccaaaaaatctcataatgttttaagaaagtttatgaatttgkgttgggccagattcaaagttgtcctgggccgcatgtggcccaccagccatggtttggacaagcttagtctacaggttcttcaagaggggcttgagcattt

SEQ ID NO: 29778 - DNA, 201 bp, Homo sapiens
aagaattgtctttggctgcacataatatacaattgttgatgagctaaaaaaaaaaaaatccccaaaaaatctcataatgttttaagaaagtttatgaattkgtgttgggccagattcaaagttgtcctgggccgcatgtggcccaccagccatggtttggacaagcttagtctacaggttcttcaagaggggcttgagcat

SEQ ID NO: 29779 - DNA, 201 bp, Homo sapiens
taataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttct

SEQ ID NO: 29780 - DNA, 201 bp, Homo sapiens
aaagtaaagtaataaacaaataagttttgggttgggcgggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctt

SEQ ID NO: 29781 - DNA, 201 bp, Homo sapiens
agcactttgggaggctgaggcaggtgaatcacttgaggtcaggagttcgagactagcctggccaacatggtgaaaccctgtctctactaaaaatacaaaawtttttttgtattttgggattcggtttaggtgatgtgtgtctgtaatcccagctacttgggaggctgagacaggagaatcacttgaactccagaggcagag

SEQ ID NO: 29782 - DNA, 201 bp, Homo sapiens
ttagtttctcttacatgtatgaagttggatagttagaatgagatgaaaataaatgggctgggcgtggtggctcatgactgtaatcccagcactttgggagkctgaggcaggtgaatcacttgaggtcaggagttcgagactagcctggccaacatggtgaaaccctgtctctactaaaaatacaaaattttttttgtattt

SEQ ID NO: 29783 - DNA, 201 bp, Homo sapiens
acctcatagaagtgagccctcttactgaattatgtggctggggttcttgggtatgttttgttctattttctggttggtggttttctttctgtcgggtcccrtgggctctttttggacctcttctcagaatgtttttcgttttttttattttttgagatggagtcttgcactgtgtcctgggctggaatgcaatggcaagat

SEQ ID NO: 29784 - DNA, 201 bp, Homo sapiens
cacacctgtaatccctgctacacaggaagctgaggcaggagaatcgcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacaactttgaatcaattc

SEQ ID NO: 29785 - DNA, 201 bp, Homo sapiens
atgctaaccaggatggtctcgatctcctgacctcgtgatccaccagccttggcctcccaaagtgctgggattacaggcattagccaccacacccggcccarattttcttataaagtcaaatgggagatacttgtttgcaagaaatagttcttttggttcttacttttccataaggattgagtctcaaaatgtctggtagca

SEQ ID NO: 29786 - DNA, 201 bp, Homo sapiens
actcagataggtgtgtattctcaagaagctttcattctaatgacacatactttgtctccagtcagagttatggcaggttttttttttttttttttttttttgactaaattcacccatatttgatggcaagtgtgatcacagcatgtttataaaaatcattcttaattaaggcatttccatcttatcaagccccctatttaa

SEQ ID NO: 29787 - DNA, 201 bp, Homo sapiens
gactcagataggtgtgtattctcaagaagctttcattctaatgacacatactttgtctccagtcagagttatggcaggttttttttttttttttttttttttgactaaattcacccatatttgatggcaagtgtgatcacagcatgtttataaaaatcattcttaattaaggcatttccatcttatcaagccccctattta

SEQ ID NO: 29788 - DNA, 201 bp, Homo sapiens
tttttttttttgaaatggagtcttgccctgtcccccaggctggtgtgcagtggcatgatctcggctcactgcaagctctgcctcctaggctcatgccattstcctccctcagcctcctgagtagctgggactgcaggcgccagccaccacgcccggctaattttttatatttttagtagagacggggtttcaccatgctaa

SEQ ID NO: 29789 - DNA, 201 bp, Homo sapiens
tttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggac

SEQ ID NO: 29790 - DNA, 201 bp, Homo sapiens
atttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatgga

SEQ ID NO: 29791 - DNA, 201 bp, Homo sapiens
gcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctctttaaggttttctcacagattaagagagtagca

SEQ ID NO: 29792 - DNA, 201 bp, Homo sapiens
atacttttaaaagtatatttatttccagaattcaatttgtaagaggtttgagggaaaaataatactgagttttgagtgtttctgattttaaaaatgtgttsagtagaattaaacgtgttcaccaaaacccattttatccctttaaattattgggcaattaattgtatttacttagcattgaatgcatgattagaaatggaa

SEQ ID NO: 29793 - DNA, 201 bp, Homo sapiens
ctaccccacgtgtccagcagcaaagccacctggcatagtgggctgctcagcgtgcctggttcatactgcgtgtttatagtcccagggtgttttcagagagyaaaagtcctttatgattagcaaattgcaggtcctcccctttctgatatttacagcccttgcaaccgcctgtacaaaaatcgggaaaaggcagaagacggc

SEQ ID NO: 29794 - DNA, 201 bp, Homo sapiens
accattgaggggagcaagatgacatgtgcctaccccacgtgtccagcagcaaagccacctggcatagtgggctgctcagcgtgcctggttcatactgcgtrtttatagtcccagggtgttttcagagagtaaaagtcctttatgattagcaaattgcaggtcctcccctttctgatatttacagcccttgcaaccgcctgt

SEQ ID NO: 29795 - DNA, 201 bp, Homo sapiens
gttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattca

SEQ ID NO: 29796 - DNA, 201 bp, Homo sapiens
tcaggctggagtgtagtggcatgatcttagctcactgcatcctctgcctcccaggttcaagcaattctccgtgtctcaatctccctagtagttgagattasaggtgcccaccaccaagctttgctaatttttgtatttttttagtagagacagggtttcgccatgttggccgggctggtcttgaactcctgatctcaggtg

SEQ ID NO: 29797 - DNA, 201 bp, Homo sapiens
tggccccatacgtatttgtaaactttcttagaacatcaggatttttatgcacggaccttttatgcatggactgtggtgttttttgatttttggttgcgtgygtgtgtgtgtgtgtgtgtgtgtgacggagtcttgctctgtcactcaggctggagtgtagtggcatgatcttagctcactgcatcctctgcctcccaggtt

SEQ ID NO: 29798 - DNA, 201 bp, Homo sapiens
cgtgatgccagtgtcttcgtaatactatctttctttcccctttagcacccagaacttatgaaatatgactcggtttatcctgaacacatgtctgtgcatcrgggaggatgggagaattaattccagtttctcaattgcaaaagtgaggctggtcatggggcttggaaccacgccacggacgcatgaagcctccccgtttac

SEQ ID NO: 29799 - DNA, 201 bp, Homo sapiens
tctacctataagtaccttccaactgttccacttttgtaaatttagttcaaataatacatatgctgaaattcctatatcccccccatactccagatcttcaktgtggaatttaaatataattccttattgtaaaaaaaaaaaatttttttttgatcaaggtgattttgataaactaaatgcatctttaattttactcacagc

SEQ ID NO: 29800 - DNA, 201 bp, Homo sapiens
ctgagaatctctatttatgtctgaccccaggaaattccctttaagctgcttgtcagaggtgcatgctgagagcatgatgggaagatggagtcttccatccrctggtaaaatctggaatctgctctcatttcattttcactgaactgaaaataaggtaacagaccctcaggtctacctataagtaccttccaactgttccac

SEQ ID NO: 29801 - DNA, 201 bp, Homo sapiens
gatttatgaggcctaactcgcaagcgatgtgtgtctggattaagagaacctgagaatctctatttatgtctgaccccaggaaattccctttaagctgcttrtcagaggtgcatgctgagagcatgatgggaagatggagtcttccatccactggtaaaatctggaatctgctctcatttcattttcactgaactgaaaata

SEQ ID NO: 29802 - DNA, 201 bp, Homo sapiens
gccaccatgcttgggtaatttttgtacttttattagagacagagtttcaccatgttggccaggctggtctcgaactcctgacctgaagtgatccacccacstcagcctcccaaactgctggaatctgagaagttacgtgaaactagcgatgccctgggctaatgaaatcaggctccatggtggggaaggatgttgcggtgg

SEQ ID NO: 29803 - DNA, 201 bp, Homo sapiens
tctttcttttttttttttgaggtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcacca

SEQ ID NO: 29804 - DNA, 201 bp, Homo sapiens
attattcccgctgccattcagttttactctgcacaaaatacagccaacatttttgcatttctttcttccttcctccttttcttctttctttccttccttccttcctttctcccttcatctatctttgttccgcttttgtttgtttttttttagatcgctgcatgctgccgcgttgggttaaccatggtagcattttaccat

SEQ ID NO: 29805 - DNA, 201 bp, Homo sapiens
aattattcccgctgccattcagttttactctgcacaaaatacagccaacatttttgcatttctttcttccttcctccttttcttctttctttccttccttccttcctttctcccttcatctatctttgttccgcttttgtttgtttttttttagatcgctgcatgctgccgcgttgggttaaccatggtagcattttacca

SEQ ID NO: 29806 - DNA, 201 bp, Homo sapiens
ccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtga

SEQ ID NO: 29807 - DNA, 201 bp, Homo sapiens
acaaagcatcagggggccgggagcagtagctcacgcctgtaatgccagcactttgggaggccgaggcgggcggatcacaagatcgggagatcgagaccatyctggctaacatggtgaaatgctgtctctactaaaaatacaaaaagaaattagctgtgcgtggtggcgggcgcctgtagtcccagctactcgggaggctga

SEQ ID NO: 29808 - DNA, 201 bp, Homo sapiens
aagcccacattttaaagggaatttggtatttttaacaaagcatcagggggccgggagcagtagctcacgcctgtaatgccagcactttgggaggccgaggygggcggatcacaagatcgggagatcgagaccattctggctaacatggtgaaatgctgtctctactaaaaatacaaaaagaaattagctgtgcgtggtggc

SEQ ID NO: 29809 - DNA, 201 bp, Homo sapiens
gtacattacagggacagtggttgggtctggagatgtcacccttagctgtttttcacaatgagaggttgttttatcataaataaatcaataaatggcagatkatacaccggagttactgagaaatataaaaaaaaaaaaagcccacattttaaagggaatttggtatttttaacaaagcatcagggggccgggagcagtagc

SEQ ID NO: 29810 - DNA, 201 bp, Homo sapiens
ataattaaccctctggggagactaatattagtttattagagacaatttctagttctgtttatttttaacactaaacgatttgttcagattggggaaaaaawttttttttttttttttggttgtggtggcgttggcttttacttggggttgacctttccttatcaaggacatacaaggtgaatagctgggtgataatatatg

SEQ ID NO: 29811 - DNA, 201 bp, Homo sapiens
gacagagtgagactttgtctcaaaaataaaatataaaataaaataaaaaggaagaaatagccagtagtgctttcttgtagacagagaagctggtgaaatgrtgtaaccaggctgggcatggtagctcacgcctgtaattcccagtactttgtgaggctgaggtgggcagatcccatgaggtcaggagtttgagaccagcct

SEQ ID NO: 29812 - DNA, 201 bp, Homo sapiens
atttatttattttcaagacatggtggcatgcaactgcagtgtcagctactccggaggccgaggcaggagagtcacttaagactgggagctcgaggcggcastgagcagtgatgactccactatactccagcctgggtgacagagtgagactttgtctcaaaaataaaatataaaataaaataaaaaggaagaaatagccag

SEQ ID NO: 29813 - DNA, 201 bp, Homo sapiens
tgtgctctcttaagccagtcggacctggttgttgtacactactgggtgtgtttaattgacttccagttttgttttgttttgttttgttttgttttgttttsaaacagtctcactctgtcgcccaggctggagtgtagtggtgtgatctctgctcactgcagcctctgcctcctgggtttaaggaattctctgccttagcct

SEQ ID NO: 29814 - DNA, 201 bp, Homo sapiens
tatatatatatatatatatataaaataatgcagaagttttatatatatataaagttttatatttatatctataaagttatatatatatatatatatatatwtatttattttcaagacatggtggcatgcaactgcagtgtcagctactccggaggccgaggcaggagagtcacttaagactgggagctcgaggcggcagtg

SEQ ID NO: 29815 - DNA, 201 bp, Homo sapiens
atatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagt

SEQ ID NO: 29816 - DNA, 201 bp, Homo sapiens
tatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcag

SEQ ID NO: 29817 - DNA, 201 bp, Homo sapiens
aggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtg

SEQ ID NO: 29818 - DNA, 201 bp, Homo sapiens
gaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggt

SEQ ID NO: 29819 - DNA, 201 bp, Homo sapiens
ggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatgg

SEQ ID NO: 29820 - DNA, 201 bp, Homo sapiens
tgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacat

SEQ ID NO: 29821 - DNA, 201 bp, Homo sapiens
gtggattacagaattgtgctgggtcctatggagtgtcagaaatagtgaagcttctggagcttcactgtccaatatggtagccacgtgtgactattaaaatrtaaattaattaaaattaaaagttcaattgctctgaaatagcagccacatttcaaatcttcagtagccagatgtggttattggctaccatattgggtagca

SEQ ID NO: 29822 - DNA, 201 bp, Homo sapiens
ttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctctctgggttcact

SEQ ID NO: 29823 - DNA, 201 bp, Homo sapiens
cttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctct

SEQ ID NO: 29824 - DNA, 201 bp, Homo sapiens
acttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctc

SEQ ID NO: 29825 - DNA, 201 bp, Homo sapiens
cacacttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtg

SEQ ID NO: 29826 - DNA, 201 bp, Homo sapiens
tctgttggctgcataaatgtcttcttttgagaagtgtctgatcatatccttcgcccacttgggtggatgaagctggaaaccatcattctcagcaaactgtygcaaggacaaaaaaccaaacaccgcatgttctcactcataggtgggaattgaacaatgagaacagttggacacaggaaggggaacatcacacaccggggc

SEQ ID NO: 29827 - DNA, 201 bp, Homo sapiens
atgagtactcactctacttttttagtttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtgccaccacaccggctaatttt

SEQ ID NO: 29828 - DNA, 201 bp, Homo sapiens
gattgcagcaggttagagcacagcatgaagagctgacaatattgaccgactggccctctcagacaaagtttgccaacacccaggtgagcagatacacttatctgtgagcagacgtgattcaggggagattgttgtccctcctttcctaagaaaatgtggaaagatgagaatgttgccaccagtgctgatatggagcgtttt

SEQ ID NO: 29829 - DNA, 201 bp, Homo sapiens
ggaagtggaggttgcagtgagccgagatcttgccattgttctccagcctgggcgacaagagtgaaactccatctcaaaaaaaaaaaaaaaaaaaaaaaaawttatgtcatttcgttgtcacagcgtcagcagaataaatcttagatcaagatgggattactgcgccactcccttcttcccagtctgtggtttagcacggga

SEQ ID NO: 29830 - DNA, 201 bp, Homo sapiens
aacggttatcagtttttgattctacacatacttcaaatactattaatgcaaaatccttctttagaaatgttacctaattccaatgtttcactttattcagygaagacattcctttgattattctggttaggtgttatgatgccaatttgcccacacattttttcttaggcgcctatgcttgcagtagacagagagttgagg

SEQ ID NO: 29831 - DNA, 201 bp, Homo sapiens
atggctgtatgacagattctagccatcaagtaaaatcagaaaccaacagcacgtttccttgaataccttttgctttctataaaatggtgtggcattgctgstattttcactcttccttcctaccctggatgctgatttgatgcttccagccttagcggttttcttgcttctaggactgaacagggaagagggaaaagtcaa

SEQ ID NO: 29832 - DNA, 201 bp, Homo sapiens
acgccaccacacctggctaatttttgtatttttagtagagatgggggtttcaccatgtgggccaggctggtcttgaactcctgacctcaggtgattgaccyacctcggcctcccaaagtgctgggattacagtcatgagtcaccatgcccgaccagcaagaccccactgctattgtccagtgtggtaggtacctttgccta

SEQ ID NO: 29833 - DNA, 201 bp, Homo sapiens
atgtatgtatgcatgtatgtatgtatgtttgagacagaatcttgctctgtcgcccaggctggagtgcaatggcaccatcttgacttactgaaacctcctcstcctggattcaagccattctcctgcctcagcctcccaagtagctgggattacaggcacgccaccacacctggctaatttttgtatttttagtagagatgg

SEQ ID NO: 29834 - DNA, 201 bp, Homo sapiens
tggagtgggatacagcaacaatctatattctgatttcagcaacactgtgcagtgtaattccatattatattacaccacatcttctgtgggtctttctttgrgggaagctaacattttaaaaggtttccctttgtaacctgtaaccccctctaccccaaaagtatattcaagagcgaaacttttggtatgacgatgtcttac

SEQ ID NO: 29835 - DNA, 201 bp, Homo sapiens
cctacgttactgcacctgtttgagcctcagttttcctgtctgcaaaggagggatgatggtacttacctcaaagaattgtagttggatcaaatgagttggartgggatacagcaacaatctatattctgatttcagcaacactgtgcagtgtaattccatattatattacaccacatcttctgtgggtctttctttggggga

SEQ ID NO: 29836 - DNA, 201 bp, Homo sapiens
gggagtgctagggtaagtggaaaaagcacatgacttggaataaagacttagtacacatcccatgtctgatttatactaactagttcatggacctagcctasgttactgcacctgtttgagcctcagttttcctgtctgcaaaggagggatgatggtacttacctcaaagaattgtagttggatcaaatgagttggagtggg

SEQ ID NO: 29837 - DNA, 201 bp, Homo sapiens
caacggcaaaaaagagaattgcacagaggaacaccacctatcagagttcacactgagtttgcagattcatccttttgcttccagccatcccatggaatgcygttcttggaagggtcatctcatggtccattgtcggccctcttagaagagatttcaggccttcccttgtagcttgatagttacagggagtgctagggtaag

SEQ ID NO: 29838 - DNA, 201 bp, Homo sapiens
aatcttggggatggggggttccactggtatattttctttactgtttaagaaagctcaaaattctctctgctcttttccaagccaccaatcaaaactgacaytttctaagtgtcctcattgccctctgggaatgttcatggcctctgggagtccaagaactacctttacactggatcttcactgcttttactattgtgtggc

SEQ ID NO: 29839 - DNA, 201 bp, Homo sapiens
ggaagaacatacttcatacaaagctatgaagcatattggaagattttaggtgccctgtcttcctggatataaaatgactccaaactcagtgatactgatcrccctggcttcttttccacctttctcacttcattgtctttttgtgtgtttctgacatctgttgacaaatgggcaatcttggggatggggggttccactggt

SEQ ID NO: 29840 - DNA, 201 bp, Homo sapiens
gagatttactgaactcagtcgtttcacctggctggggaggcctcaaaattatggcagaaggcaaaggaggagcaaaggcacatcttacatggcagcagacmagaaagcgtgtgcaggggaactgccctttataaaatcaccagatctcatgagatttattcactatcaagggaacagcacaggcagatcccatggctttga

SEQ ID NO: 29841 - DNA, 201 bp, Homo sapiens
gaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagca

SEQ ID NO: 29842 - DNA, 201 bp, Homo sapiens
atactctatttcagttgagtttttagtttgctctgttacgtgaggacacatcacttgcacctcagtgtgagtttgaaagtgttttctctggagaataattytgaagaaataggccctccagatatcagtagtgacaggggtatcagtaatgttgattactaagttcttgccacaggtagaagccatgctactgcacaagtt

SEQ ID NO: 29843 - DNA, 201 bp, Homo sapiens
agccactgtacctggactccactatgccttcccctccccttccctcccttccccaccctaaagagtctcgctcttttccccaggctggagtgcagtggcastatctgggctcactgcaacctgtgcctcccggattcaagagattcttgtgcctcagccttccaagtagctggttttgcaggcatgcaccaccacacccag

SEQ ID NO: 29844 - DNA, 201 bp, Homo sapiens
ggacacatttttaacatagacaccaaaagagaggctggaagagttgaccacttagaaatgtcacgagtgtctgtgaatagtgttgggggctgagaggcaaragaagaaaatagtcctaatgttgtacaagtagcaatggaaacaaacttgttaaaaaaaatttaattttgtttatgcatgtgtgcataaacaaagcaatag

SEQ ID NO: 29845 - DNA, 201 bp, Homo sapiens
aacagtcagagtgtccaagtaatctgagctagaaagttccttctttcagagaaaagttataaaaagtatatttgccggatccaaaaaaaatactgtgtatsaactactgagacctgcataatgttttcttagtattctcactctttaaaagaaaaaagaaaacctgtaaaatttgggaacttaaactttttttgatatttt

SEQ ID NO: 29846 - DNA, 201 bp, Homo sapiens
gtcatggtgattgtcaactgtcttggcgctggtgagggggctgtttagcatggaaataggattataatgacacctgaggtctttttgaagtccttgggtcrgctatcttgcttctaacaaatctcagctggtctggttacagagggaactttttatcacaggtgtcctgtttcttaaagataagcagtgttattacagggt

SEQ ID NO: 29847 - DNA, 201 bp, Homo sapiens
tcttgaaatgggcagtgaacttcccggaaccagagtgttgccttcctttttatccttttatggctgcttctgatcattgtcatggtgattgtcaactgtcytggcgctggtgagggggctgtttagcatggaaataggattataatgacacctgaggtctttttgaagtccttgggtcggctatcttgcttctaacaaatc

SEQ ID NO: 29848 - DNA, 201 bp, Homo sapiens
tagagggtggggagagagttcagtatgtcaggactgctacatttatgagtgtgggtctttattgaagtctctctttgtagccaatccttttttttttttttaatttttaaattttaaattcttacttttagatatgggggtctcactctgttgcccaggctagagttcagtggcacaatcatagctcactgcaacgttgac

SEQ ID NO: 29849 - DNA, 201 bp, Homo sapiens
tgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccac

SEQ ID NO: 29850 - DNA, 201 bp, Homo sapiens
ttattgatttgtaattcaacaacttcaacatcttaccaagaagaatgtgcagttattctagcaggagaaacaatgcaattagagcctgcgagatgaaatcmaattgttttataatgagaaattagggaattcgaggcagacattagctgtgtaattgtggaaagggaagaactgtagttagagcatattagaaatctggcc

SEQ ID NO: 29851 - DNA, 201 bp, Homo sapiens
ggaagatgtgatttcattcttcatgcttgtaaattattatttaagctgtgaataccctctcttttcccactgaagttgtggttgtaagattctcagagttragcagactcggcaacattacagaaaaaaaatcaagatgtaaaaaggatttagacgtctggacgtggtggctcatacctgtaatcccagcactttaggagg

SEQ ID NO: 29852 - DNA, 201 bp, Homo sapiens
atctgatgggtgtatcaggagtttccgcttttgcttcttcctcattttctcttgccactgccatgtaagaagtgccttttgcctaccaccatgtttctgargcctccccagccatgtggaactgtaagtccagttaaacctctttttcttcccagtctcaggtatgtctttatcagcagcgtgaaaacggactaatacagt

SEQ ID NO: 29853 - DNA, 201 bp, Homo sapiens
caatctatatgtccaacgccattcgtagaccccctttgataatctccactaagcagacatactcgatacatcttcactaatgagttctgacttcataaaawgtattaatgacttctttttgaaagtaagagtgctttgaataccagtcgttattgctttagaagttcataaaagcaaaagcacagtatttcccccagtgtt

SEQ ID NO: 29854 - DNA, 201 bp, Homo sapiens
gccagtgattctatataaaccgttcagtaaaatgaatggcatatgcgtatgtttcaagagctccagcagcctacccaggatggcttgatgttgtctcttarcaccgtatcaatacctgggggttttcaaatattgcaggtggccgaagcctttgtgttgaggtttctgtagtgtttatccatttgtgaaaccaggcctcaa

SEQ ID NO: 29855 - DNA, 201 bp, Homo sapiens
tattgaatgaagacatgaaagcatttggtggaaatagggcacacacatgaatatattcacagttgcaaactcagaaggatactcccaacctggttctttgkcttgtccctccatctgggtgctttccagtcacagcctggatgcatgtatgaataaacttctaccattaagtccctgaattatttaagcactgccagtgat

SEQ ID NO: 29856 - DNA, 201 bp, Homo sapiens
cttgtggttccttgtagtaatttgcatccactgaccctcccactcccctgctactctgttccttgactataaatctccagctgtctttattatatttggarttgagccctatctctctcccctattgcaacagccttgacccctgttgaaataatcctgcataaagtcttccttaccattttaacaaatgtcaaggtaact

SEQ ID NO: 29857 - DNA, 201 bp, Homo sapiens
gttggaatactcctacccttgtggttccttgtagtaatttgcatccactgaccctcccactcccctgctactctgttccttgactataaatctccagctgkctttattatatttggagttgagccctatctctctcccctattgcaacagccttgacccctgttgaaataatcctgcataaagtcttccttaccattttaa

SEQ ID NO: 29858 - DNA, 201 bp, Homo sapiens
caggacaggtgccctcctcagcggagacaactgtccccctccatcctgcaggagttttgcagccatccttccagccactgcttctctaccggggcaaattytcccccaagggataattgataatgtctgaggcatttttaattgtcacaacttggggaaggggcaagggattgagggagagtgctcctggcatctggtggg

SEQ ID NO: 29859 - DNA, 201 bp, Homo sapiens
atagaaacttttgccttcattatatcacctttacaccccaggacaggtgccctcctcagcggagacaactgtccccctccatcctgcaggagttttgcagmcatccttccagccactgcttctctaccggggcaaattttcccccaagggataattgataatgtctgaggcatttttaattgtcacaacttggggaagggg

SEQ ID NO: 29860 - DNA, 201 bp, Homo sapiens
tgagagaatagaaacttttgccttcattatatcacctttacaccccaggacaggtgccctcctcagcggagacaactgtccccctccatcctgcaggagtwttgcagccatccttccagccactgcttctctaccggggcaaattttcccccaagggataattgataatgtctgaggcatttttaattgtcacaacttggg

SEQ ID NO: 29861 - DNA, 201 bp, Homo sapiens
ccaccatattgagagaatagaaacttttgccttcattatatcacctttacaccccaggacaggtgccctcctcagcggagacaactgtccccctccatcckgcaggagttttgcagccatccttccagccactgcttctctaccggggcaaattttcccccaagggataattgataatgtctgaggcatttttaattgtca

SEQ ID NO: 29862 - DNA, 201 bp, Homo sapiens
gtacaaatgaacttgctacttggtttgctgccaattgctgccgaaacaggagttatttaaattagtaaataatttttgaaatcttcttagaatgtcacagsccacaattcaaattcacagaccaggaatggttattatttctatatatcttaaagttttctgcaatagaaatgcatttcaaatataagctagaaaaaaaaa

SEQ ID NO: 29863 - DNA, 201 bp, Homo sapiens
gagcttctctttgttcccatatgtttcagtgaagcagttatagcttcagaaaagagggagccaggaaatacacttgtaattcatcactccttttatagtcmgagcataggaacactcatagtatgtatcagaaactagtgaacacatgttgttttacagctctgtctgcaaaattgcatcgtgggcctctttggggagtgt

SEQ ID NO: 29864 - DNA, 201 bp, Homo sapiens
tgacagagtgagactccatctcaaaacataagtaaataaataaaaaataaatataatacagacacaggcttttctccccacctcttttaattcttgaaagraacagtaacaagctcctattcctgtttccttgccaggagaagtattgttttcatataaatcatttgtgacagaagctccttatttttaagtggaaaatgc

SEQ ID NO: 29865 - DNA, 201 bp, Homo sapiens
agtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccgggg

SEQ ID NO: 29866 - DNA, 201 bp, Homo sapiens
agagtccctgtgcttcccagtttactctggagacgactgaggctcacagaggttaagccacctacccaggctggcaccgcacactttgttcagagtgggcytggcatacggcatcagttcagcctggccctagacccttttcctcccacaaccatattgcccccagtggagagacaggaaagcagggaagggggcaattgc

SEQ ID NO: 29867 - DNA, 201 bp, Homo sapiens
cccctgggcaggtgcatgagggggtcccaggcaatcaggctcttctcaaacctgaattatacccggcctcagggtataggggtcaggcagctgtttgacargattcttgcaaatgtttttggtttctctgtctactcattacgtacactctgccagaggttgaaaactcaatgttgagatcacatacatcctgaaaacact

SEQ ID NO: 29868 - DNA, 201 bp, Homo sapiens
cccaaagcttgctgtcccctgggcaggtgcatgagggggtcccaggcaatcaggctcttctcaaacctgaattatacccggcctcagggtataggggtcargcagctgtttgacaggattcttgcaaatgtttttggtttctctgtctactcattacgtacactctgccagaggttgaaaactcaatgttgagatcacata

SEQ ID NO: 29869 - DNA, 201 bp, Homo sapiens
aagcacgggggtttatgtgatggctccacagagcagtgaaaagactcccgccctactgctcgcaacctcagatgtccctgggcactagcccatctgtatgkctttaaaaaaaataaattaaatttttaaaaacatgactttctggccaggcgcagtggctcatgcctataaccctgcacttagagagggcaagacagaagg

SEQ ID NO: 29870 - DNA, 201 bp, Homo sapiens
cacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtc

SEQ ID NO: 29871 - DNA, 201 bp, Homo sapiens
ggccaccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaac

SEQ ID NO: 29872 - DNA, 201 bp, Homo sapiens
tttcgtttgttctgtttcccactgagagaattttctagctttatgtggagaaaacagtattggaaattattactcagttcaagaaaacctcactgagcacytaccatgtaggtgctcatcccgataccactatcaggccctttggaccagttgcaaggatgcaggatgaggaaggcaatgtgagaaaacagaaggagcacc

SEQ ID NO: 29873 - DNA, 201 bp, Homo sapiens
tcaaaaaaaaacaaacaaacaaacaaaaaaaaaacaaaacacatgctggtgcacacataaatttggaagaaatgctctttaacccagtatgagcacgtggkattcttatcctcattttacagatgaggaaattgaggcacagacagattcaataactacgtgactcacagagataaccgtgtagcagaatcaggaattcag

SEQ ID NO: 29874 - DNA, 201 bp, Homo sapiens
tgcatctgtgaagattccatttctaaataagatcacatgctagggctgggcacggtggctcatgcctgtaatcccagaattttgggaggccgaggcaggcrgatcacttgaggtcaggagtttgagaccagcctggccaaaatggcaaaaccccttctctattaaaaatacaaaaattagccaggtatggtggtgcgtgcc

SEQ ID NO: 29875 - DNA, 201 bp, Homo sapiens
ccaggatgacctcattttaccttaacaagttgcatctgtgaagattccatttctaaataagatcacatgctagggctgggcacggtggctcatgcctgtartcccagaattttgggaggccgaggcaggcggatcacttgaggtcaggagtttgagaccagcctggccaaaatggcaaaaccccttctctattaaaaatac

SEQ ID NO: 29876 - DNA, 201 bp, Homo sapiens
agggactcaagtcattggatttagggctcactggaatccaggatgacctcattttaccttaacaagttgcatctgtgaagattccatttctaaataagatyacatgctagggctgggcacggtggctcatgcctgtaatcccagaattttgggaggccgaggcaggcggatcacttgaggtcaggagtttgagaccagcct

SEQ ID NO: 29877 - DNA, 201 bp, Homo sapiens
acaagaggtcacattgccttttctagcttggaaggtggcgcaaataactgcttgaggctccctctcttgggccaagcttgactctggattttcattgttgkccttttttattaaaacaggttttgtttttttgtgtgtgtgttattttgttttttgtttttttgtttttcgggggctggagtagtgtgcagagcctggcgg

SEQ ID NO: 29878 - DNA, 201 bp, Homo sapiens
ccactgagcacatcctcgtggatcttcctggctctccttacaaggggttccttccaaacccaagcgccacaatccttaggcagattgctctgacacagaasactggtgagttctagacttgatgtgtttcatgggaaacaggaagacatttaggggaggctgtagatacacagccgctctgtttagggaaggctgtcgata

SEQ ID NO: 29879 - DNA, 201 bp, Homo sapiens
tgaaaatgttagcaatatagtaatgaacaaaacagatgttatctctacccttatggtttttatattttaataaaagtggcagaaaagaaataggtaaaacwataaactgagctctttggagaagaggcccacgttcttttcagattctgatttctccgtgatataaatagttttttaggtgatcacttgtttttaatgtac

SEQ ID NO: 29880 - DNA, 201 bp, Homo sapiens
tcttcacctgggtgggcgatttgaatagagctcacagccctgaaaaccctggttttcagactctttattggtaaatgaagtcagcttagtgatatgagaawtatgaaacataaatccctttgtaaaaatataaaataatcttacaatcatcatcgtcatcctcatcatcgtgttccttcacaccagcggtatttatggtat

SEQ ID NO: 29881 - DNA, 201 bp, Homo sapiens
ctgtaatcccagctactcgggagcctgaggcaggagaatcacttgaacccgggaggtggaggttgcagcgagtcaaggtcacgccagtgtactccagcctsggtgacagagcgagactccgtctcaaaaaaaaaaaaaaaaagaaaaagaaaaagaaaaaggtgtttggaagccatgtcccatgaattccaaatacaattg

SEQ ID NO: 29882 - DNA, 201 bp, Homo sapiens
tacattattatgaggattattttctacctagatcaggtataaggtggatgtattattggcattcctaggactgttttaaaggaagtacctatgaggcctcrtgataagccagatgtccagaagccagcttgagaccagggctcctggtcacttaaaagatgtttggggctgggcgtggtggctcacacctgtaatcccagc

SEQ ID NO: 29883 - DNA, 201 bp, Homo sapiens
tggggagtattgctagctattcccatagggagtgagagagagtgtaagtaaaatgcaatggcaggcacagggatggttgccattatcagttacattattakgaggattattttctacctagatcaggtataaggtggatgtattattggcattcctaggactgttttaaaggaagtacctatgaggcctcatgataagcca

SEQ ID NO: 29884 - DNA, 201 bp, Homo sapiens
tcagttgggatcagaaggccacaaagttttcttatattttaagcatcaaagtagcaccactgtacagcatctttacttaatctgccctctttcacgtgtgkgcatccctggcatgcttaaacaagaaaggcaaatgagagagagcgagtgagtgtgagcgagagagccctgaggtgccagaaggctgtggttcctttgtgt

SEQ ID NO: 29885 - DNA, 201 bp, Homo sapiens
tttggttttttttgtattttagtagagacgggatttcaccatgttggccaggctggtctcaaactctggacctcaaatgatccaaccgcctcggacttccraagtgctgggattacaggcgtgagccaccgtgactgacctgtttttaatttttttagagacagagtttcacactgtttaccagattggagtgcagtggtg

SEQ ID NO: 29886 - DNA, 201 bp, Homo sapiens
tcactgcaaactccacctcccaggttcaagggattctcctgcctcagtctcccaagtagctgagattacaggcgcccaccaccaagcccagctaatttttktggttttttttgtattttagtagagacgggatttcaccatgttggccaggctggtctcaaactctggacctcaaatgatccaaccgcctcggacttccaa

SEQ ID NO: 29887 - DNA, 201 bp, Homo sapiens
cagtgtgatcttggctcactgcaaactccacctcccaggttcaagggattctcctgcctcagtctcccaagtagctgagattacaggcgcccaccaccaarcccagctaatttttttggttttttttgtattttagtagagacgggatttcaccatgttggccaggctggtctcaaactctggacctcaaatgatccaacc

SEQ ID NO: 29888 - DNA, 201 bp, Homo sapiens
tgtcacccaggctggagtgcagcagtgtgatcttggctcactgcaaactccacctcccaggttcaagggattctcctgcctcagtctcccaagtagctgarattacaggcgcccaccaccaagcccagctaatttttttggttttttttgtattttagtagagacgggatttcaccatgttggccaggctggtctcaaact

SEQ ID NO: 29889 - DNA, 201 bp, Homo sapiens
gaatacactagtaggtacagcaggagagcatgtagaagaggatagatgtagaaaatcgggacggcatgttaggaatatagataggaattactaaggaaaaktgtatttttgtggaattctttgaactcgttactattagtaaacggtgagttttggttctactcttcaatgagtttaagatgaaggaaatcattaaatagt

SEQ ID NO: 29890 - DNA, 201 bp, Homo sapiens
tacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctcc

SEQ ID NO: 29891 - DNA, 201 bp, Homo sapiens
taccctggaacttaaaagttggtgaaagaaagaaggggccgggcatggtggctcacgcctgtaatcctaacattttgggaggtcgaggcaggcagattgcytgagctcaggagttgaataccagcctgggcaacacggtgaaaccccgactctactaaaatacaaaaaattagccgggcgtggcagtgtgtgcctgtaatc

SEQ ID NO: 29892 - DNA, 201 bp, Homo sapiens
gagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtgc

SEQ ID NO: 29893 - DNA, 201 bp, Homo sapiens
agagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtg

SEQ ID NO: 29894 - DNA, 201 bp, Homo sapiens
gagagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagt

SEQ ID NO: 29895 - DNA, 201 bp, Homo sapiens
aataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctact

SEQ ID NO: 29896 - DNA, 201 bp, Homo sapiens
taatggatttttagcctcaagtttctggaattctaagagggcctgaaaggtaagtgctcacttactgaggtgtgtgaacaaaaacaggcaacctagctcarcaagtaagaatggagtggcatctccccacctgctctggagtcatgtgtttgcttctggaagggaggcaagaggcattcaacctcctgttaatttggttgc

SEQ ID NO: 29897 - DNA, 201 bp, Homo sapiens
gattctgccgataaacatcatctggacggaatgaagctgagggccaatagtttagaggctcagcacccgactggagagagagagagagagagagagagagwgtgtgtgtgtgtgtgtgtgtgtgtgtgcgcgtgcatgtgtatacgctggtgtttaggtgggcttgagaaaagtgctgactttgtgaacgaggaggaggga

SEQ ID NO: 29898 - DNA, 201 bp, Homo sapiens
tggattctgccgataaacatcatctggacggaatgaagctgagggccaatagtttagaggctcagcacccgactggagagagagagagagagagagagagwgtgtgtgtgtgtgtgtgtgtgtgtgtgtgcgcgtgcatgtgtatacgctggtgtttaggtgggcttgagaaaagtgctgactttgtgaacgaggaggagg

SEQ ID NO: 29899 - DNA, 201 bp, Homo sapiens
ttgaggcaggagaatcatttgaacccaggaggcggaggttgcagtgagccaagattgcgccactgcactccagcctgggtgacagagcaagactctgtgttaaaaaaaaaaaaaaaaaagttctaaatcagtggattctgccgataaacatcatctggacggaatgaagctgagggccaatagtttagaggctcagcaccc

SEQ ID NO: 29900 - DNA, 201 bp, Homo sapiens
cgggtgtggtggcgtgtgcctgtaatcccagttactcgggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttc

SEQ ID NO: 29901 - DNA, 201 bp, Homo sapiens
gagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgtgccactgcgctccatgctaggtgacagagcaagattc

SEQ ID NO: 29902 - DNA, 201 bp, Homo sapiens
gccatgttggagagggatccaacatttattatccccattttacagatgaagaagttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgg

SEQ ID NO: 29903 - DNA, 201 bp, Homo sapiens
agcaaggtgttgatagaaccccttagtgtcctcctcataccacagacactctcttcccccacttacttggccaattttttttttttttttttttttttttkggtggagtctcgttctgtctcccaggctggagtgcaatggtgcgatctcagctccctgcaacctctgcctcccatattcaagggattctcctgcctcagc

SEQ ID NO: 29904 - DNA, 201 bp, Homo sapiens
gaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatc

SEQ ID NO: 29905 - DNA, 201 bp, Homo sapiens
agatattccagctatggcaaactgcggaagaattaggacagatgtatgacttatttcatataaagctaaatcagtttaatttatatgattgtcctttattmtgagattatgttcaacagatattttcagtgttaaaatattcttttttttttttttttttgagacagggtctggctctgtcacccagggtctagcacagtg

SEQ ID NO: 29906 - DNA, 201 bp, Homo sapiens
atggggtcataagacattggtgaggttaggccttcctttgtctcccaggagcacacttgatagcaatgtagggtgaattccaaatctgtgagttagtgccrtatatagcagtgttgtcagtaagatttctcactggcatctctgcttcccctcttgactctcttgaaatcccttcttcaggcagaagttggagtcatttct

SEQ ID NO: 29907 - DNA, 201 bp, Homo sapiens
aactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaat

SEQ ID NO: 29908 - DNA, 201 bp, Homo sapiens
gtgatttcagggtgttgggctctgacaagatgatgccgacttagacagtgttagtcaacatcaaatgtctggatcaagagaggcaagaatcccgtggattkggcgttggccagaacttgtctggaatcttgttttctgccttgagtgtcacctgttgagagctctgttgacaaactggcatttgtccttgggagagtagcc

SEQ ID NO: 29909 - DNA, 201 bp, Homo sapiens
ggcacctatgttaactctatttcattttggaaaagttgagtagacaaaaggtgcagagtagagtatgcagtgatttcagggtgttgggctctgacaagatratgccgacttagacagtgttagtcaacatcaaatgtctggatcaagagaggcaagaatcccgtggatttggcgttggccagaacttgtctggaatcttgt

SEQ ID NO: 29910 - DNA, 201 bp, Homo sapiens
ggaggcacctatgttaactctatttcattttggaaaagttgagtagacaaaaggtgcagagtagagtatgcagtgatttcagggtgttgggctctgacaaratgatgccgacttagacagtgttagtcaacatcaaatgtctggatcaagagaggcaagaatcccgtggatttggcgttggccagaacttgtctggaatct

SEQ ID NO: 29911 - DNA, 201 bp, Homo sapiens
tgtgtcttctcccccatttatttatttaatcatttatttatatcacagtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgt

SEQ ID NO: 29912 - DNA, 201 bp, Homo sapiens
ttggaggagtgttgctgtgcccagctcacgcttgtggagtggggatttaatgttctcactcttcgagggtagagtatctgcataaactacttggaattctrcatggaatatttgtgtcttctcccccatttatttatttaatcatttatttatatcacagtacactcatggacatttattttatgctttatgttataatcc

SEQ ID NO: 29913 - DNA, 201 bp, Homo sapiens
gtgctgggattacaggtgctagccaccacacccggcctcttctcgatagatcttatttggctgacaacgaaagctgttgtgctggtagcatcatccctttscatgcaaaagataaactgaaatctgaagtagccatatccttccggccaggtttttcaagtggttactctgttctgatcattgtcatgacaggaatagtga

SEQ ID NO: 29914 - DNA, 201 bp, Homo sapiens
acattgtattttatggttgcagagcacacgtatcatcctatctgcttctgacacccagtaagcagctctggcttttataattttgatgaaagaagtttccyaacagtatttcggtgtgcatgctcacacaccagccctggtcgtcagtgaacagattcttccaggtcttcattgtggcggaagaaagtgagatcagagatc

SEQ ID NO: 29915 - DNA, 201 bp, Homo sapiens
tattcaaaatgtacacacagcgtaaatgcaagaaaagaatctgatgtaaaaatggcccttccaacatctagcattattgtgtgttgaataaatacttgttygattaggtctaatcactcttcatgattggatttccaaaatgtggactctcagcagtacattacagggacagtggttgggtctggagatgtcacccttagc

SEQ ID NO: 29916 - DNA, 201 bp, Homo sapiens
tcatagtttaagtcatcaggtggtgactggaggagccagaaggtccctttgggcctgtcctctcaccagcatcaactgcaccaaaaagatctcattctgaktatcagggatgaacccccccactgggtgatcaggcaaactacatgcattttaaaaaactatatcctgctgggtgcagtgcctcatgcctgcaatcccagc

SEQ ID NO: 29917 - DNA, 201 bp, Homo sapiens
gccagtgtgtctctttctctggacggccaagtgatgcaggtaccacgcttaggtctgctggtgtttagcttgacttaaaacccagccagggaaatatgttwcactttgctggggtgcaggtggaggaggctattattcttaggcatttaacagtgaagaatgttgggcagggcagagggtcagctgaatggcagggattcc

SEQ ID NO: 29918 - DNA, 201 bp, Homo sapiens
tctatttctttgtgacctgatagtcttgctctccagggtaaaagaagaggatggaaatggctgtggggcgcctgaggtgggccctggcatgatggcaagtkgccgttctgggttcactgggatggctcaaggggagtttggaaaccctcctaacatgtcatctgaaatctgggaccacagttccggctggaacacttgtca

SEQ ID NO: 29919 - DNA, 201 bp, Homo sapiens
cttctatttccagaaccttctaactctatttctttgtgacctgatagtcttgctctccagggtaaaagaagaggatggaaatggctgtggggcgcctgagstgggccctggcatgatggcaagttgccgttctgggttcactgggatggctcaaggggagtttggaaaccctcctaacatgtcatctgaaatctgggacca

SEQ ID NO: 29920 - DNA, 201 bp, Homo sapiens
atggacataaagcctggggtggtgatggtgctgcctctgtaaccaggctcagctgtgtgtcttcgtgagcctccttgtggaccctcaaatgtgggaaggakataggggcaggaggaattggggaaataggaaccttagaaaccctgaagaagtggaaagagaaaaggaaggtcagtcattcattcaattgcttaatttgct

SEQ ID NO: 29921 - DNA, 201 bp, Homo sapiens
ttgaccaggcttgggtgctctcctgcagggcattgcaatctttaggacaccttcattacccctcctaaaaggagattttataatgagcgccaaccagctcwaacaagttaggatctcctaacatgtctggtgaaaatacaggagtatttttcatcatctctggaaaagttgctatcatgtccttcaataacccagtctaac

SEQ ID NO: 29922 - DNA, 201 bp, Homo sapiens
ctggtatctccacttctctctgcagcgtgatgtctagtcagagtttccattctgtttttatgaccctgggaggactgggacagatctgtgaggtcatcttrtccaccctcagccagggcaggagtattccctaatggtagagtcaagtgtttggtttggtcttgtttctaatgactcaagtgatgaggcctggggacgtcc

SEQ ID NO: 29923 - DNA, 201 bp, Homo sapiens
cttcccccaagtgtgtttccctttgtaatgccagtgtcgtaacgccactatctatacttttcaacacaattccaagtgctacctctgcatggcagaaactrtcaaccgtggatggtttctttttagcttgtccttcccgttctacagcatggaggttaagagctctggctttggttccaatcgtgtcccctttcctccctg

SEQ ID NO: 29924 - DNA, 201 bp, Homo sapiens
aatttatactcactggggtggtgagaaggttaagggcaatgatgtatacaagacattagcatttgctataaggaggatgtatctcagttgccatatttgtrtcactaaccatttgaagattttgtgttcaagatttggaagagaatcttcttcccaagccagcattttatattttgcattaaaaaaaaccacaaaagacaa

SEQ ID NO: 29925 - DNA, 201 bp, Homo sapiens; identical to SEQ ID NO: 8559

SEQ ID NO: 29926 - DNA, 201 bp, Homo sapiens
ataatttgcttaagtgtgcacaaggtggaaggtcacgcaaggaagctttttattagttgtgtactgaatggatcaatagtgatttgaatactataaatctrtccgttaacaggtttatttcttcatcagatattaattccagagggtttcacccattataaaatggacataaagcctggggtggtgatggtgctgcctctg

SEQ ID NO: 29927 - DNA, 201 bp, Homo sapiens
tggccccaaccaattaaatagtgaaatgtcgactgcattcaggcccttcctggtctgcagacagacttgtgttagttcattttcatagtggtgtgtatgtrtctttagactttaactgacagattcccacagtgagtagagtagggagttatcaattacatggttagctaggcgctgctattgtatgctctatggcttctt

SEQ ID NO: 29928 - DNA, 201 bp, Homo sapiens
agccagctcaaatttcagtgttggatgttcaccgcttctttagggttctaccactcccagtaaatcaagtaataggtttctgttaaaaaccccagtgtgcygatctcagtggcagccatcttgctttgtaagccttctctagctttatgatgctcccagtatataagacatttccagtgtctagtccaaattagtatttct

SEQ ID NO: 29929 - DNA, 201 bp, Homo sapiens
taagatttacagatattaacgactccttgggaaaactggacttcagtcgcctctctccaacaaaaaacgactattgggcgatgctggcttataacaggtcsaagctctgcaacatcctcttctccaacgagctgcaccgtcgcctctccccacgcggggtcacgtcgaacgcagtgcatcctggaaatatgatgtactcca

SEQ ID NO: 29930 - DNA, 201 bp, Homo sapiens
tggaagccccagtaatatcatttaattcgaaagcttttttctatgatgaattattcaggcagtgtttaccaaaattgtcattgatcagtacagacccagasagcatgtacaacagcgcctgtgctgggcctgctaggagtcgatattttctggctcaaagaagttccaaaagaattcaaagccagtgtgtctctttctctg

SEQ ID NO: 29931 - DNA, 201 bp, Homo sapiens; identical to SEQ ID NO: 8560

SEQ ID NO: 29932 - DNA, 201 bp, Homo sapiens
tagaatcttgagttgatacctccttgggtggcatggagcctatacctttgtagatcttgggaaacaacttctaaagtaatcatagttgtatgtaatcgtarttacaacaatagttattttaggcacataacccaaaggttttcttacaaggaatctatgaaccttaagagtgagggcttctgttaagagtaagggcttccc

SEQ ID NO: 29933 - DNA, 201 bp, Homo sapiens
cttctaaggtgccgattctcagtgatagaatcttgagttgatacctccttgggtggcatggagcctatacctttgtagatcttgggaaacaacttctaaartaatcatagttgtatgtaatcgtagttacaacaatagttattttaggcacataacccaaaggttttcttacaaggaatctatgaaccttaagagtgaggg

SEQ ID NO: 29934 - DNA, 201 bp, Homo sapiens
ttctaaggtgccgattctcagtgatagaatcttgagttgatacctccttgggtggcatggagcctatacctttgtagatcttgggaaacaacttctaaagkaatcatagttgtatgtaatcgtagttacaacaatagttattttaggcacataacccaaaggttttcttacaaggaatctatgaaccttaagagtgagggc

SEQ ID NO: 29935 - DNA, 201 bp, Homo sapiens
ttgatacctccttgggtggcatggagcctatacctttgtagatcttgggaaacaacttctaaagtaatcatagttgtatgtaatcgtagttacaacaatarttattttaggcacataacccaaaggttttcttacaaggaatctatgaaccttaagagtgagggcttctgttaagagtaagggcttccctggagtggacat

SEQ ID NO: 29936 - DNA, 201 bp, Homo sapiens
aattaatgttgagaatctagtcaatctgccagcagtacgtacataactgttctgtgtatatttcacatggccatatatgttttgcttgtgtggtgctaaaygcaaaggcagagaagcttctgctattgaatgcttagcacagaactcctgtcctccctctttgaaattattccgacagttgcccctcatttggcttgccaa

SEQ ID NO: 29937 - DNA, 201 bp, Homo sapiens
tcctgcctcagcctcccaagtagctgggagtaaaggcacatgccaccatgcccagctaatttttgtatttttgttagagatggggtggccaggctggtctwgaactgctgacttcgagtgatccaccggccttggcctcacaaagtgctgggattacaggtgtgagacattgtgcccagcttggagcatcttaatttaagc

SEQ ID NO: 29938 - DNA, 201 bp, Homo sapiens
ttgacagtccacttcattaagtggaggacagtgttttgattgctatttaatctgtttttccttctgtctgttcttggctatatggaattcactttgcctcycttcccgactcttcatatcccttatctcaaggtgagtatcgtcagaatcccggtacatttcaccagccaccttttatagaagcttagaaagatggaggca

SEQ ID NO: 29939 - DNA, 201 bp, Homo sapiens
taagggtgttttaacaaaatggcaatttccccaggctggcttgtgtattaccttcgcattgcatcccttggctcccatgagtgagcgtggtgacttggtgygtaggtggtacgtgaagacagttgctcactacccaagaactcagggccctaaaccatgctgtaaaatgcaagtgctgatatctaattacctccatcaacc

SEQ ID NO: 29940 - DNA, 201 bp, Homo sapiens
ttccttcctcagaccccaaagtagctgggaccacaggtgcacaccaccacttccagctgattatttaaaaaaaattttgtagtgacagtgtcttgctgtgyttcccaggctgttcttgtactcctgggctcaactgatcttcccagcttggcctcccaaagtgctgggaatacaggtgtgagccactgtcccaggccagtt

SEQ ID NO: 29941 - DNA, 201 bp, Homo sapiens
agatattcccctttcttctaaatatacttgaccaccaccattcaggttcttctattaaccctcctatatttgccaaccctcaacctgttagaaacaagaawtgggactctggagtagatgttagcaacatcatgagctcaaacccctccagcttacagcggagacagtgaggtcctgtaggatgaggttggagagcaggaa

SEQ ID NO: 29942 - DNA, 201 bp, Homo sapiens
agaatcttgagttgatacctccttgggtggcatggagcctatacctttgtagatcttgggaaacaacttctaaagtaatcatagttgtatgtaatcgtagktacaacaatagttattttaggcacataacccaaaggttttcttacaaggaatctatgaaccttaagagtgagggcttctgttaagagtaagggcttccct

SEQ ID NO: 29943 - DNA, 201 bp, Homo sapiens
tgattacaggcgtgagccaccacgcccggcctctttgcacattatttaagggtgttttaacaaaatggcaatttccccaggctggcttgtgtattaccttygcattgcatcccttggctcccatgagtgagcgtggtgacttggtgcgtaggtggtacgtgaagacagttgctcactacccaagaactcagggccctaaac

SEQ ID NO: 29944 - DNA, 201 bp, Homo sapiens
ctctagagtggcaggcgaactctgattttgaggaaaaaggatagggtaatggtgttgacacaggcactgttgaatacgtatgtacatattttaatagtttkctcattaatcaaatggaaatgctatcgattttataggatcgttgtgagaagaagtgagaattgaaatgaaaggcatctagtcttccccggtccccatcca

SEQ ID NO: 29945 - DNA, 201 bp, Homo sapiens
acttgtctaagaatcctcatcttaaccctgtgctagaacaacaagcttggaaggagccagccaacaggagaaagccagagcaagactctgtgctggacaaraagtcctgagcactggggagttgacttcatattggaggcagagaagaattacctgccgatggctgttggcccatggcaacaccctagatcgttgcatttg

SEQ ID NO: 29946 - DNA, 201 bp, Homo sapiens
tttccccaggctggcttgtgtattaccttcgcattgcatcccttggctcccatgagtgagcgtggtgacttggtgcgtaggtggtacgtgaagacagttgstcactacccaagaactcagggccctaaaccatgctgtaaaatgcaagtgctgatatctaattacctccatcaaccttggcagaatctcttcgttggagtt

SEQ ID NO: 29947 - DNA, 201 bp, Homo sapiens
gcaatttccccaggctggcttgtgtattaccttcgcattgcatcccttggctcccatgagtgagcgtggtgacttggtgcgtaggtggtacgtgaagacasttgctcactacccaagaactcagggccctaaaccatgctgtaaaatgcaagtgctgatatctaattacctccatcaaccttggcagaatctcttcgttgg

SEQ ID NO: 29948 - DNA, 201 bp, Homo sapiens
aagtagctgggaccacaggtgcacaccaccacttccagctgattatttaaaaaaaattttgtagtgacagtgtcttgctgtgtttcccaggctgttcttgwactcctgggctcaactgatcttcccagcttggcctcccaaagtgctgggaatacaggtgtgagccactgtcccaggccagttttaactcacaatgatttc

SEQ ID NO: 29949 - DNA, 201 bp, Homo sapiens
aaaacctcatttctgctaaaaatacaaaaatcagctggttgtggtggtacacccctgtaatagcagctactcaggagtctgaggcaggagaatcccttgarcccaggaggcagagattgcagtgagcccagatcatgccactgcactccagcgtgggtgacagagcaagactctgtctcagaaagaggaaagaaatggaat

SEQ ID NO: 29950 - DNA, 201 bp, Homo sapiens
catcacaaaacctcatttctgctaaaaatacaaaaatcagctggttgtggtggtacacccctgtaatagcagctactcaggagtctgaggcaggagaatcycttgaacccaggaggcagagattgcagtgagcccagatcatgccactgcactccagcgtgggtgacagagcaagactctgtctcagaaagaggaaagaaa

SEQ ID NO: 29951 - DNA, 201 bp, Homo sapiens
gtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcccttgaacccaggaggcagagattgcagtgagcccagatcatgccactgcactccagcg

SEQ ID NO: 29952 - DNA, 201 bp, Homo sapiens
aggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttct

SEQ ID NO: 29953 - DNA, 201 bp, Homo sapiens
aaatcagtatgattcatcataaataagtcaggactatgattgacagtctacctagaaagattaggaaagtggggaccaccccccaattattacctttgttyttacaagtgtgtttaaatctctttctgttaatttacaatttgaaaggtgggtgaggagaagagtttgaaaaatagattactgtcttcattaatacaggtt

SEQ ID NO: 29954 - DNA, 201 bp, Homo sapiens
ttatttaaaaaaatcagtatgattcatcataaataagtcaggactatgattgacagtctacctagaaagattaggaaagtggggaccaccccccaattatwacctttgttcttacaagtgtgtttaaatctctttctgttaatttacaatttgaaaggtgggtgaggagaagagtttgaaaaatagattactgtcttcatt

SEQ ID NO: 29955 - DNA, 201 bp, Homo sapiens
ttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatg

SEQ ID NO: 29956 - DNA, 201 bp, Homo sapiens
ggtgacaggcttctttcttctcatcattaaatgacatactggagatcagtcagatgaactgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgt

SEQ ID NO: 29957 - DNA, 201 bp, Homo sapiens
tttgttccctctgcatatagcactttctcaaaaagtagtttggtgacaggcttctttcttctcatcattaaatgacatactggagatcagtcagatgaacwgcaatttatatcttgcccccacccagtgttgatttgcccggggtcatacagataattagtaatgtcttatctcagttttcttatctgcaaaatgagaata

SEQ ID NO: 29958 - DNA, 201 bp, Homo sapiens
agatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcg

SEQ ID NO: 29959 - DNA, 201 bp, Homo sapiens
cccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagttta

SEQ ID NO: 29960 - DNA, 201 bp, Homo sapiens
tgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtt

SEQ ID NO: 29961 - DNA, 201 bp, Homo sapiens
agtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatccca

SEQ ID NO: 29962 - DNA, 201 bp, Homo sapiens
gattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgc

SEQ ID NO: 29963 - DNA, 201 bp, Homo sapiens
gtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaataga

SEQ ID NO: 29964 - DNA, 201 bp, Homo sapiens
gagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagccta

SEQ ID NO: 29965 - DNA, 201 bp, Homo sapiens
gaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaa

SEQ ID NO: 29966 - DNA, 201 bp, Homo sapiens
ttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctt

SEQ ID NO: 29967 - DNA, 201 bp, Homo sapiens
ggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgcctt

SEQ ID NO: 29968 - DNA, 201 bp, Homo sapiens
agatgggtttatgcctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggacctt

SEQ ID NO: 29969 - DNA, 201 bp, Homo sapiens
aagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcgtggatgcgggagg

SEQ ID NO: 29970 - DNA, 201 bp, Homo sapiens
tgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaa

SEQ ID NO: 29971 - DNA, 201 bp, Homo sapiens
ttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgca

SEQ ID NO: 29972 - DNA, 201 bp, Homo sapiens
gaatacaaggggggataaagatagacttaaaatacgctctctagaaaaaagtaagaaatatggaaagaaatctaatttagaaaaatgcacgcacccacagrcacgcttcacaggactggcaggtggagaggatgtttgttaacagggctggctattttactttaagtgctgcaaacattgcactaatgtttgggtctttgc

SEQ ID NO: 29973 - DNA, 201 bp, Homo sapiens
gagtgagaccctatctcaaataaaaataaaaatagaatacaaggggggataaagatagacttaaaatacgctctctagaaaaaagtaagaaatatggaaakaaatctaatttagaaaaatgcacgcacccacaggcacgcttcacaggactggcaggtggagaggatgtttgttaacagggctggctattttactttaagt

SEQ ID NO: 29974 - DNA, 201 bp, Homo sapiens
gtaaaaaaaatcatctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgc

SEQ ID NO: 29975 - DNA, 201 bp, Homo sapiens
tttgggaggtcaaggcggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatcacgccactgcaca

SEQ ID NO: 29976 - DNA, 201 bp, Homo sapiens
ggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcatctcacacctgtagcc

SEQ ID NO: 29977 - DNA, 201 bp, Homo sapiens
gcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaac

SEQ ID NO: 29978 - DNA, 201 bp, Homo sapiens
attttatttcaggaccttggtaaggggttatacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctcccctt

SEQ ID NO: 29979 - DNA, 201 bp, Homo sapiens
ttctttaaaaaaaatttatgacatattacttttgctaattatgtgtgtgggtagattatgttattcatgaattttatttcaggaccttggtaaggggttayacaatatttcttttgaaacgagggtctcgattattgggcttgagtatcctgatctaattaatgcactggacagagctggcagacgtgtgggacacccagc

SEQ ID NO: 29980 - DNA, 201 bp, Homo sapiens
ttttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagtt

SEQ ID NO: 29981 - DNA, 201 bp, Homo sapiens
atgagagcagattttgcctgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgc

SEQ ID NO: 29982 - DNA, 201 bp, Homo sapiens
cggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcacc

SEQ ID NO: 29983 - DNA, 201 bp, Homo sapiens
gggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgc

SEQ ID NO: 29984 - DNA, 201 bp, Homo sapiens
tattttgcattgtttatgtcagcattaagcagtattcttacacagtttgtaagtcttaaaactcagtatctactctagtagttgctccaaatgtgatgtcstcataaatcaccgagggatcttgttaaatttggattctgattcagtaggtctaggtggggcccgagcttctttgtttccttttcttatttaatttttgtg

SEQ ID NO: 29985 - DNA, 201 bp, Homo sapiens
acttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtct

SEQ ID NO: 29986 - DNA, 201 bp, Homo sapiens
gaaaaggaaagacaacagataagtgattgccagggactggagaggagtggggggtgagtgggaaccagagtggatataaaacagcaactggaggatcctgrtatagatggaaatgttctgcatcttgactgtctcaatgtcaatttcctggttgtgaaatcgtactagagttttgtgagatatcacctatgggggaaactg

SEQ ID NO: 29987 - DNA, 201 bp, Homo sapiens
catctcaaaagagaagaaaagagaagaaaaggaaagacaacagataagtgattgccagggactggagaggagtggggggtgagtgggaaccagagtggatwtaaaacagcaactggaggatcctggtatagatggaaatgttctgcatcttgactgtctcaatgtcaatttcctggttgtgaaatcgtactagagttttgt

SEQ ID NO: 29988 - DNA, 201 bp, Homo sapiens
catcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggca

SEQ ID NO: 29989 - DNA, 201 bp, Homo sapiens
tgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatgg

SEQ ID NO: 29990 - DNA, 201 bp, Homo sapiens
tgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaa

SEQ ID NO: 29991 - DNA, 201 bp, Homo sapiens
ccagggacggctccttggcaagttgtactgctgtggcctagggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactact

SEQ ID NO: 29992 - DNA, 201 bp, Homo sapiens
tttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagccagtggccccagcagagataggaggccctctctgtgattt

SEQ ID NO: 29993 - DNA, 201 bp, Homo sapiens
agtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcac

SEQ ID NO: 29994 - DNA, 201 bp, Homo sapiens
tatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcaga

SEQ ID NO: 29995 - DNA, 201 bp, Homo sapiens
tcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggt

SEQ ID NO: 29996 - DNA, 201 bp, Homo sapiens
aaaataatgattataactatgacctccagaagcttttgctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctg

SEQ ID NO: 29997 - DNA, 201 bp, Homo sapiens
taatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacacaggggaggaaaacatccttggcaggttcgcatattgg

SEQ ID NO: 29998 - DNA, 201 bp, Homo sapiens
gttctgtgccaaggattttagaaagtcatgtctcattcagttcccctaacaggtctaggagtcattatcctccccaacctaaggaaactgagacccagagrttcagagtatcccaagatcctacaggaattgcagattgtagccaaaattggaactcctaattccagagctcctccctcctgctagcatttttctttgagt

SEQ ID NO: 29999 - DNA, 201 bp, Homo sapiens
atcatcacacctttcccttagcctgtactaggttctgtgccaaggattttagaaagtcatgtctcattcagttcccctaacaggtctaggagtcattatcytccccaacctaaggaaactgagacccagaggttcagagtatcccaagatcctacaggaattgcagattgtagccaaaattggaactcctaattccagagc

SEQ ID NO: 30000 - DNA, 201 bp, Homo sapiens
ttatatataataataatttaatttataactatatcatttattaaggtcctactatataccaaattctattggacacatgtcctaataataaacgtgatatmatctatcattatttacaaaacttcacactctgacctttattaattatgtgtgtgccaattatgtgcagggaactgtattaatcgtagttagcaatatcgt

SEQ ID NO: 30001 - DNA, 201 bp, Homo sapiens
tgggcatttttaaattatcattagtatataattatatataataataatttaatttataactatatcatttattaaggtcctactatataccaaattctatyggacacatgtcctaataataaacgtgatataatctatcattatttacaaaacttcacactctgacctttattaattatgtgtgtgccaattatgtgcagg

SEQ ID NO: 30002 - DNA, 201 bp, Homo sapiens
gagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtc

SEQ ID NO: 30003 - DNA, 201 bp, Homo sapiens
tctctactaaaaataaaaaaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaac

SEQ ID NO: 30004 - DNA, 201 bp, Homo sapiens
cacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatccc

SEQ ID NO: 30005 - DNA, 201 bp, Homo sapiens
attacattttttgaatatgtttcttctttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaa

SEQ ID NO: 30006 - DNA, 201 bp, Homo sapiens
ctgcctccatctccctttctctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttaaagatggtgcaagggaaccagagagct

SEQ ID NO: 30007 - DNA, 201 bp, Homo sapiens
tttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttctttgcctcttgaggactaac

SEQ ID NO: 30008 - DNA, 201 bp, Homo sapiens
ggggccataggctgccaagctgtggtttctaggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggta

SEQ ID NO: 30009 - DNA, 201 bp, Homo sapiens
gtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccacgttaactagtacattgatgctgttgtgtgc

SEQ ID NO: 30010 - DNA, 201 bp, Homo sapiens
gaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacg

SEQ ID NO: 30011 - DNA, 201 bp, Homo sapiens
ttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgct

SEQ ID NO: 30012 - DNA, 201 bp, Homo sapiens
tatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaa

SEQ ID NO: 30013 - DNA, 201 bp, Homo sapiens
ccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcc

SEQ ID NO: 30014 - DNA, 201 bp, Homo sapiens
gccacaggactatagcctgggcagttttgagtgctgcctctaccatgtaactagcttgccagtcaagtcattaactattcggggccttagtttcgtctttyctgaattggagccagtatacgtaattccaaaggttgcttttaagcgtaagtgagaatattggcagaaattcgttagcactgagagagggaatgtaaagtg

SEQ ID NO: 30015 - DNA, 201 bp, Homo sapiens
gcagtgaactaagatgccacaggactatagcctgggcagttttgagtgctgcctctaccatgtaactagcttgccagtcaagtcattaactattcggggcmttagtttcgtcttttctgaattggagccagtatacgtaattccaaaggttgcttttaagcgtaagtgagaatattggcagaaattcgttagcactgagag

SEQ ID NO: 30016 - DNA, 201 bp, Homo sapiens
agtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttg

SEQ ID NO: 30017 - DNA, 201 bp, Homo sapiens
gggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagcct

SEQ ID NO: 30018 - DNA, 201 bp, Homo sapiens
cagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttccttttta

SEQ ID NO: 30019 - DNA, 201 bp, Homo sapiens
agatatataatgatgcctatctgattctgtggtggtctggctttgatgtatgtatatgtgggcaggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgtt

SEQ ID NO: 30020 - DNA, 201 bp, Homo sapiens
ctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctcctgtgtgtgtgttcatcacgtatccattgtgtctccaaggtcttatcaacagcaacaaaaggc

SEQ ID NO: 30021 - DNA, 201 bp, Homo sapiens
acatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctatta

SEQ ID NO: 30022 - DNA, 201 bp, Homo sapiens
ttttgtgacattcttagttgtgatctaccttatgttgtatacacatggtcactcacatacataggtatattattctgcaattgctgagtaattgatgatcsttcattctctctgtgattcataggctctctgggttggataaatcacttcggggaattatatctactagtatatttatgtcactagaattcctttgagaag

SEQ ID NO: 30023 - DNA, 201 bp, Homo sapiens
ctttggtaattcagtatccgaaaaacaatcagtgttttgtgacattcttagttgtgatctaccttatgttgtatacacatggtcactcacatacataggtrtattattctgcaattgctgagtaattgatgatccttcattctctctgtgattcataggctctctgggttggataaatcacttcggggaattatatctact

SEQ ID NO: 30024 - DNA, 201 bp, Homo sapiens
caatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttg

SEQ ID NO: 30025 - DNA, 201 bp, Homo sapiens
gggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaaccc

SEQ ID NO: 30026 - DNA, 201 bp, Homo sapiens
atgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttg

SEQ ID NO: 30027 - DNA, 201 bp, Homo sapiens
gcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaa

SEQ ID NO: 30028 - DNA, 201 bp, Homo sapiens
atcgtgtccagcctaaatggcattcttggaagtaaaaccacaggggatctgttggaagtggcatgatggaggaattttaaaagaattgaacaaataaaatrgtcagagctcaaaaattgagtactgcttcgtttctcccaaataaccatcaccagacaaacaggtgtgtgtgtgggtgggggaggtggcctggtggtactt

SEQ ID NO: 30029 - DNA, 201 bp, Homo sapiens
gtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaat

SEQ ID NO: 30030 - DNA, 201 bp, Homo sapiens
gttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccc

SEQ ID NO: 30031 - DNA, 201 bp, Homo sapiens
aaagtggagttggggaacacgttattatatagtattttcaccacacacaggatacagtcaatgacttcaagagcataggtaacagtaaaatgtagtaaaasaatttagaagtcatgagttttgagtacttagtactttttagtatgatttatttaatagtaaccttatataatgtttttcttttaattgttttattgagat

SEQ ID NO: 30032 - DNA, 201 bp, Homo sapiens
agaccttgatatatgtacatatattgtatgatacatatccatgcatatacgtgggtgtacacacacaggtacacacaaatatatatgtgcctttggacaaraaaaaatccccaggacagtctcatttggcttttaaaatgctgcagttgaataggaccgtagaggtggcctaaggcagccttccattcagggcacgcagat

SEQ ID NO: 30033 - DNA, 201 bp, Homo sapiens
ccggagtttaatggatcaagtagcggtgataggttttatggctcttttttactttagggcatagggaagagagagccgggcaggttggttttaaattcaargatttatgttgttaatcctccgggctaattataatttatgggatcttggcaaattaatatgcagttgctattcaaaagtggagagcaatgtaaggcaggc

SEQ ID NO: 30034 - DNA, 201 bp, Homo sapiens
ggaaaaggccagcagccacgttccttgttttgtgtaattggtctttagcctgatctgattcatctggcgaaacccctttttccagtaaaagtcgttggcgrggagtgaattgtgatggaaacagagacagatgtatgtacctttcatggacataatttccccaagactgaacacaaaaatgagggtttttggagatctctc

SEQ ID NO: 30035 - DNA, 201 bp, Homo sapiens
taacttgtctaagaatcctcatcttaaccctgtgctagaacaacaagcttggaaggagccagccaacaggagaaagccagagcaagactctgtgctggacmagaagtcctgagcactggggagttgacttcatattggaggcagagaagaattacctgccgatggctgttggcccatggcaacaccctagatcgttgcatt

SEQ ID NO: 30036 - DNA, 201 bp, Homo sapiens
agatccagtggagtgtggggtgctgagagaacaagtctatgttttcttgagacaaagtcttgatctgttgcccaggctcgagtgcagtggcagcatcttgrctcactgcaacttctgcctcccgtgttcaagtgattctcctgtctcagcctcctagggagctgggattacaggtgtgcaccactatgcccagctaatttt

SEQ ID NO: 30037 - DNA, 201 bp, Homo sapiens
agagggttgcctgggacaaaggcattataagcttattcatttaacttgagtacagggtttctcaagctttggcactgccaacatgtggggttggataattytttgttgggatctgccctgtgcattgtaggatgtttagcagcatccctggcctctacccactagatgccagtagcatcccttccccctcttgtcacaaac

SEQ ID NO: 30038 - DNA, 201 bp, Homo sapiens
gccctttattagtcactcatggtgtcacaagccctttacaaagcactttgcatgcaaatgattcctcataacaaccttgggaggtagttactttcattgtrttagctatctcttgctgtgtaagaaattaccacaaatttagtatatttgttatctcatagctccataggttaaaagtcctggttcaggctgggacttctg

SEQ ID NO: 30039 - DNA, 201 bp, Homo sapiens
ggactctggatagggtttggctggttgagtctcctcttgcagtggctgttgatggaggtcatttagtggaatccagttggcaggagagctggccttggagrgtctaggatggcttttgtcacatgtccagggctttgtcaggttagcagggcagggagggctcagctggtctcagctcgtggctgctccagcaccgtggtc

SEQ ID NO: 30040 - DNA, 201 bp, Homo sapiens
atgtctgatgaactcatctttgcttccttggatccccaagatagaatggccctaatgcagtcaaaccaccctgcagaatcttaacagcaccacaaatattrcatccaggcatcctgcccatgctggcttgcaggctggggatccctgtccatagcgcccatggctccaccaccagtcaaaggtagtggggccagcagtgga

SEQ ID NO: 30041 - DNA, 201 bp, Homo sapiens
agagtgaggataaataagaacaagaatgacaaaccgataggctacttgacatcattccttaattccaggtcactggcggacatcactcattcatcagtackctgtttttctcccaagaatggatctgactcttgaattctctttaatagagtgttctgggaggctgttaccaattgaccagggttgatgcacatgttgaaa

SEQ ID NO: 30042 - DNA, 201 bp, Homo sapiens
cacagtgcgtggtctgcatggcacagtgtgtggtctgtatggcacagtgcatggtccgcatggcacagcgcatggtccgcgtggcacagcgcgtggtccgygtggcacagcgcgtggtccgcgtggcacagcgcgtggtctgcgtggcacagtgcgtggtctgcatggcacagcacatggacatgattcatacatgcaagt

SEQ ID NO: 30043 - DNA, 201 bp, Homo sapiens
gctgtggcttcagagggtggaagccccaagccttggcagcctccatgtggtgttgagtgtgtgggggcacagaagtcaagaattggggtttgggaacctcygcctagttttcagaaaatatatggaaacacctggatgccccagcaaaagtttgctgcatgggtggagccctcatggagaacctctgctagggcagtgctg

SEQ ID NO: 30044 - DNA, 201 bp, Homo sapiens
aaaggatatgcgaagcacttttcatgcattatttaacctagctataatactcccatttgacagatgagaggactgaggcttgtagactttccaaggctgtkcagctctaggtctagtctgccatttgaatttgggcgatgataccagagaccaagttctcaactatgatatactgcacatgtttttgtttttgtattttgg

SEQ ID NO: 30045 - DNA, 201 bp, Homo sapiens
tgcctgccctctggttgaaacatcagtgttgaatcaatagaccacgtcctgtccataccttgggaattagactcacccagactctgagttaagagtttctrtgagacagagggctggactgggggagcaaggcttgcaaatcgaaagcatcagttgctacccctgagcaccatctcccataggagactctttgaacacttt

SEQ ID NO: 30046 - DNA, 201 bp, Homo sapiens
tttctttttaatgcagaagatttcttatgtgattaactgaatgggaattgatgctttgtggaatgaaatggattgagtacagagtgtgggatcaagaactwttaggcactgtgagtataagagggaaaccaggccgggagcagcggctcacacctgtaatcccagcactttgggaggcggaggcgggcagatcacgaggtc

SEQ ID NO: 30047 - DNA, 201 bp, Homo sapiens
ttcagggataccaacttgggtgctgaaaagcagcgatggcaggactatttacaccacggaaacaggcaaaaactactgatcaagccttcactgttttgttwatattgtcttgacttagaaagtgattgcaatgttaataatgcagattaaattgaagcgtacagtgcctataaaccattacattatgaatagtataaaaaa

SEQ ID NO: 30048 - DNA, 201 bp, Homo sapiens
acttccctactaggtagagcaatgattccagaagtttataataattggaaagtgtattagtcgattctcacactgctataaagacattcctgagactgggmaatttataaagaaggaaggtttagttggctcgtggttctgcagactgtataggcttctgcctctcgggaggcctcaggaaacttacagttatggcagaag

SEQ ID NO: 30049 - DNA, 201 bp, Homo sapiens
gccaagagcatagaggtggaattgttgtgtgagcctgtagagtccgtgttcttacccactgcatgatgtctgatcatcgtcaattttctttccatttggayagatgaatggtaacacttccctactaggtagagcaatgattccagaagtttataataattggaaagtgtattagtcgattctcacactgctataaagaca

SEQ ID NO: 30050 - DNA, 201 bp, Homo sapiens
gtataatccacagcactccttctgaatacgttacgtaaatggaaccctcgcaacagtcttatccccattgtagagatgagaaaactgaggcatacagaagrgatggaactaggccaagagcatagaggtggaattgttgtgtgagcctgtagagtccgtgttcttacccactgcatgatgtctgatcatcgtcaattttct

SEQ ID NO: 30051 - DNA, 201 bp, Homo sapiens
tgtatctagtaattgctatgcacttatatgtatagaagcgtataatccacagcactccttctgaatacgttacgtaaatggaaccctcgcaacagtcttayccccattgtagagatgagaaaactgaggcatacagaagggatggaactaggccaagagcatagaggtggaattgttgtgtgagcctgtagagtccgtgtt

SEQ ID NO: 30052 - DNA, 201 bp, Homo sapiens
ctctatttctttgtgacctgatagtcttgctctccagggtaaaagaagaggatggaaatggctgtggggcgcctgaggtgggccctggcatgatggcaagwtgccgttctgggttcactgggatggctcaaggggagtttggaaaccctcctaacatgtcatctgaaatctgggaccacagttccggctggaacacttgtc

SEQ ID NO: 30053 - DNA, 201 bp, Homo sapiens
cagcaaggtatgtacggtttaaagtgtaatcaattttgaggttgtatacaaggatatacatgataaatacaagtagtagcatttttagtaaaggctgttayaaaatactgtatttatggcctattccattctttttatagctcattaatgtagaaaacaaacacagtgtatccatcttctcagacggtttaaaattccctt

SEQ ID NO: 30054 - DNA, 201 bp, Homo sapiens
cagcccaggaaggagctttaatttgagtaattgttttcactaattcatcttcacagaaagaaataatatgatcaccttcggttagtaaacaaaacaaatasgcaaacaggtttacaggctgaggtgggctggatcacttgaggccgggagtttgaaaccagcctagctaacacggtgaaacccttctctactaaaaataca

SEQ ID NO: 30055 - DNA, 201 bp, Homo sapiens
tcatgtcacaagatcttgttgatgtgcatgcattcattcattcaacaaatattattgagcatctaacataagccgggtgctttgctagggacagaatgctrtacaaggtccctgtcctcatggggaccgtatgttgggaagacagatgataggcatggaaatgaagagacaaaccactccgacttcagcccaggaaggagc

SEQ ID NO: 30056 - DNA, 201 bp, Homo sapiens
aaaatcatgtcacaagatcttgttgatgtgcatgcattcattcattcaacaaatattattgagcatctaacataagccgggtgctttgctagggacagaakgctgtacaaggtccctgtcctcatggggaccgtatgttgggaagacagatgataggcatggaaatgaagagacaaaccactccgacttcagcccaggaag

SEQ ID NO: 30057 - DNA, 201 bp, Homo sapiens
tcacagcctggatgcatgtatgaataaacttctaccattaagtccctgaattatttaagcactgccagtgattctatataaaccgttcagtaaaatgaatkgcatatgcgtatgtttcaagagctccagcagcctacccaggatggcttgatgttgtctcttagcaccgtatcaatacctgggggttttcaaatattgcag

SEQ ID NO: 30058 - DNA, 201 bp, Homo sapiens; identical to SEQ ID NO: 27090

SEQ ID NO: 30059 - DNA, 201 bp, Homo sapiens
tggagatggttgtcttcttttttattccatgaaacaaattgattaatgtgtcgagggagcaaggtggtacttatacctacccagcctgcttgtgtgtgtckcaaggtggagagaggctgtggaaacaatagagagaatagcatggaaggccacgttgcaattaaacaagattgggaaagaagacgggactaaaatcatgcc

SEQ ID NO: 30060 - DNA, 201 bp, Homo sapiens
gttaactggttcctatttctgctggttcgaagaggtccaggacatttaaatagctcttctagaaacaaattcttttccttacaagccctgccaggtcagtkggttcagtaaggaagaaggttttgtattttgacaattccttcatctgttaatttagtcagacgaggaaggaaacgagaaaagttattcctatttcatcca

SEQ ID NO: 30061 - DNA, 201 bp, Homo sapiens
agtaacattataataaaactttgactcatgctcataactcgattttccaaaaagttttcctttacaggagaaaagaacagctgctgtttataggagcatamattgtttttggttattttgaagaacaagttggcatttttgaccgaaattaaacacatgccttttgatcaagcaattccattctgtaccagaaaatacaga

SEQ ID NO: 30062 - DNA, 201 bp, Homo sapiens
actagaggccttttccctagtagtaacattataataaaactttgactcatgctcataactcgattttccaaaaagttttcctttacaggagaaaagaacakctgctgtttataggagcatacattgtttttggttattttgaagaacaagttggcatttttgaccgaaattaaacacatgccttttgatcaagcaattcca

SEQ ID NO: 30063 - DNA, 201 bp, Homo sapiens
tgctagacatgcccttagcgagcagctcatgagagcagattttgcctgtttcttccaaaatctggattcagtgacatcgtgttggtagcttgaaactgacygtggtgagaatatttacaccatggaaattggcaaatgctactaataaggatgattgttttagttttcattttgtaattttcagagttggtttaccaatat

SEQ ID NO: 30064 - DNA, 201 bp, Homo sapiens
tacctcgccctatgtgtcttttcatctctgtccttagtactgtcctttataataaagcagtaagtggtagcaagtgttttcctgagttctgtcatctgctscagcaaattaatcaaacccaaagagggggttatgggaacttccacctgaagcccctcagccagacattctgaagtctctgacttgctattggtgtctggg

SEQ ID NO: 30065 - DNA, 201 bp, Homo sapiens
ggagatccatttggatagtcttgaacacagaactgaccggaactgacttactctttgaaaagatcgctctggctgctgtgttgagtggattggtaagggayaggtggtgaagactgaaacagggtatccagttaggaagctaccacagtgatccaacccccagcttctgttgaggttgaagaacctgcatgcccaacctaa

SEQ ID NO: 30066 - DNA, 201 bp, Homo sapiens; identical to SEQ ID NO: 8561

SEQ ID NO: 30067 - DNA, 201 bp, Homo sapiens; identical to SEQ ID NO: 8562

SEQ ID NO: 30068 - DNA, 201 bp, Homo sapiens; identical to SEQ ID NO: 14793

SEQ ID NO: 30069 - DNA, 201 bp, Homo sapiens; identical to SEQ ID NO: 14794

SEQ ID NO: 30070 - DNA, 201 bp, Homo sapiens
ttttggaaaccccagcagagccttcatctttaactgtgtgaccttgggccattgaaataacgtttaatcttggttttttcacctgtaaaatgggttgataygagggtcagttcaggcactgtgcgtaaagcacatagcaccgtgtctagtaggtactctctgttccttaactgtcgttccttgattgctcttaagatacga

SEQ ID NO: 30071 - DNA, 201 bp, Homo sapiens; identical to SEQ ID NO: 8563

SEQ ID NO: 30072 - DNA, 201 bp, Homo sapiens
tggaacacagccaggtgcatttgtttacctattgtctatggctgcttttgcactacagtagcaaagttgagtacttataaatgtagagcctgcaaagtctraaatatttactatctgcccttttgcaggtaaatttgaggactcttgagttagacagctaattagttggtgttacctaaattttgtgaattgtggctaaat

SEQ ID NO: 30073 - DNA, 201 bp, Homo sapiens
ttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccaggctggtctcgaactcctgggctcaagcaatgcactggccttggcctccc

SEQ ID NO: 30074 - DNA, 201 bp, Homo sapiens
gcacaggaattatttcccttttaaacgttagttttcattttaccagtgcaactctgctattggcacatctatgaaatacgtaaagctatcattttaatacyaaagaggaaacacaaatttgactcatttccccagaaaattcccctcctgctttccatatgttatatagttaactgtaaaagtggcaccacctcttaaaca

SEQ ID NO: 30075 - DNA, 201 bp, Homo sapiens
aaatggtggcaatgaaatcattgcgtaggccagttggagtgagccaaataaaatacatctgcagtccagattcaacctgcaggccatcattctgctgtcaytggtgtagaagactttttcagcctagtttattctaggctcttttcatttctccctgatttgaggctttgtaggacgttgcacaggaattatttccctttt

SEQ ID NO: 30076 - DNA, 201 bp, Homo sapiens
aggcgtgtgtcactgcatccagcttaagttatccgatttgtaaatggtggcaatgaaatcattgcgtaggccagttggagtgagccaaataaaatacatcygcagtccagattcaacctgcaggccatcattctgctgtcattggtgtagaagactttttcagcctagtttattctaggctcttttcatttctccctgatt

SEQ ID NO: 30077 - DNA, 201 bp, Homo sapiens
tttggcctcctgggtagccgggactacaggcgtgtgtcactgcatccagcttaagttatccgatttgtaaatggtggcaatgaaatcattgcgtaggccasttggagtgagccaaataaaatacatctgcagtccagattcaacctgcaggccatcattctgctgtcattggtgtagaagactttttcagcctagtttatt

SEQ ID NO: 30078 - DNA, 201 bp, Homo sapiens
catggcaaagacccatcattgatgagtgactggatgtgaggaatggagcaggggagatgctgatgatttggttacccccttctccatcccccaccacccaytgatgttattatccagtaaggaccaggagagaagaagagatttaagaagaagacaatggctgtggtttgatgaagataaaacgccctgccagaatcattt

SEQ ID NO: 30079 - DNA, 201 bp, Homo sapiens
attcaaggatttatgttgttaatcctccgggctaattataatttatgggatcttggcaaattaatatgcagttgctattcaaaagtggagagcaatgtaargcaggcataaacaagccttgttcatttttaatttatttccaccaatggagaatattaaataaaatgaacactggggtatttcgctccaagtttggtgttc

SEQ ID NO: 30080 - DNA, 201 bp, Homo sapiens
gcgtagtttcacgcctctaaaagtcccctgaaagtgttattaaaagtactatctggccatgtcctcatttccccagcaaagtccttctgagaatttaggckctttaggctagaggatctcagtgctcagaatgaaatatccctgtactccaagatgcctccagcaattataattgaatcttgaagctagagtttcttggct

SEQ ID NO: 30081 - DNA, 201 bp, Homo sapiens
gcataatgcaattaaggcccattggattagaatttgcaggatgccattagcaataagctctgagtgtagattattgccgtgcttaaattttctccttcagyggtaacacttctcttgtaaattctaactgggtaaaataaatatgatataaaacagacacaaataagaatatatagatgatgttaatttcttcagagcttc

SEQ ID NO: 30082 - DNA, 201 bp, Homo sapiens
gtgccaggtggccaagatggggcttgtgatttgaagcttcttttcctagattcaggaaagtatcactggttaatcagggaatacatctttcggcccattgkaaaatgtctgttcttagcaccctaaatgcccaggtattagcatacttgggaaatgtctagaaacccctatttcaatttactgaccatttttggtaaattc

SEQ ID NO: 30083 - DNA, 201 bp, Homo sapiens
gagtagatgttagcaacatcatgagctcaaacccctccagcttacagcggagacagtgaggtcctgtaggatgaggttggagagcaggaacttgcccgagrtcatgtgcagagttcgaggcagggcctggatgggaagcccagcatggagaccccaggccgtctctccgccatcttgttgtgatgcttccggaagaatgcc

SEQ ID NO: 30084 - DNA, 201 bp, Homo sapiens
accaccaccattcaggttcttctattaaccctcctatatttgccaaccctcaacctgttagaaacaagaaatgggactctggagtagatgttagcaacatmatgagctcaaacccctccagcttacagcggagacagtgaggtcctgtaggatgaggttggagagcaggaacttgcccgaggtcatgtgcagagttcgagg

SEQ ID NO: 30085 - DNA, 201 bp, Homo sapiens
atagcttgctgcactcttgctgggtatgtgtaattattcccatttcacccgatccctgggagtttggtgaattaatcacccagcatccaaatagctaaccrgtagcagagctgggattcaaactcagttaggctgacttctgtgcctgttttcttgcctaagcggtggacgcattgagtaggagaaggccagttattcctc

SEQ ID NO: 30086 - DNA, 201 bp, Homo sapiens
tttaggcagcagaatgagactatgtctcaagaaaatgttcaagaagaaatacaaactattgaaaaaggaaggctgaatgctttatcagaaaactgtatttrgaggggacctttctggggtcttttagtcagggtacataagtgtcagctgctacgacaaacaacttgcaacgtctcattatcttcatacaacaaacgctga

SEQ ID NO: 30087 - DNA, 201 bp, Homo sapiens
ttaaatttttatattgaataatctttgatttgtattgtcatgttgttttatagcagttactgctgttttagtgtgatttgggatgaaaattttaaaaaatmaatatgtataatccaccatctttgttccttttatttttatgttactcattcttttaagcttgtcttagacgtgagtattatgttttattttgctgggaga

SEQ ID NO: 30088 - DNA, 201 bp, Homo sapiens; identical to SEQ ID NO: 8564

SEQ ID NO: 30089 - DNA, 201 bp, Homo sapiens; identical to SEQ ID NO: 8565

SEQ ID NO: 30090 - DNA, 201 bp, Homo sapiens; identical to SEQ ID NO: 8566

SEQ ID NO: 30091 - DNA, 201 bp, Homo sapiens
caggaaggtaaaatttggaggtgcaggcagagtcaaggtcatgcctgaggcccaaccttcctgttgaagctggtgtttgattcaagctgtggctgagaacrtgcagctcatctggagggtagagttgcaagacatgggttcaggtctgagccaagccagaaactggagaaagcgtggcttctcaagactaggaatacctag

SEQ ID NO: 30092 - DNA, 201 bp, Homo sapiens
ttcccatcaacaactcttgtgcccacgagggactggcctcctcagtgccacacagagcctcccctgagtagatttgtgtcattttcaaacaaagcatcctsgctgcagtgttggattttgtaggatggtgaccgtttacagaaacctctggtccgtgagccaatttggagaaaattgaatcattctctgtgcctttcggct

SEQ ID NO: 30093 - DNA, 201 bp, Homo sapiens
cgcccggccagagggctattctttgtcttttatttgctttgagtctggtataaccatgtggcacatacccctgtacatgtttgccaagactgctatatggyagagcttggaattcttaggagctttatcaggtaattgcaagtcccccacctccaagaaagcactctctaggtcaagaatcagcaaatgttttctatagag

SEQ ID NO: 30094 - DNA, 201 bp, Homo sapiens
gaacctttttgatgcctccaggcaatttcctacaagctctaatatcttcctctttactcccatatgtggtatctctggtaccctatatatcattcactcarctgtttgttttgaaccacttattttggcaagacttcttcagacaggagagccctgagagctcttcaaaggctgggcctgatggtgtttgtcagagaggtt

SEQ ID NO: 30095 - DNA, 201 bp, Homo sapiens
caaaacattcaagaggtgacttgggtgctgttaaaggcattcagttttataaaagaagcagagcatcaaggtttggaaaatttgcagtctgattgtgcgayagaaaagaaaaacccattttctggggagaaattcaagctggctgcagaaatttgtgtaagtggcaaggaacctaatgttaatctcgaagaccatgaggaa

SEQ ID NO: 30096 - DNA, 201 bp, Homo sapiens
ttccagagcgtcttcctgatgttgcatagagcactcacacctaacagatctcagaacttgtatcttttctgggtggctagactgaaaaatccattttcttrtgagtgagccagaggtctgtctcttgcggcatttctgcttttgagaacctcccgtttcctgaaaggcaccagaccccaagacagctctgctgcctgattg

SEQ ID NO: 30097 - DNA, 201 bp, Homo sapiens
gctataaagttttagctagacagcgaatcaaggtggcaacacatggtgggttcttaaataatagttgtcatttgagtgctttctatatgatgtacatttcmttttgcactttacaaataacctcttcctttttctgtttaatcttaaaaaagatcccgggaggcaggcgttattgtgcccatttcctggataaggagaatg

SEQ ID NO: 30098 - DNA, 201 bp, Homo sapiens
agggagtgaatgaatgagggatttgcagcttgaacgctgtactttgaaacagttccagattcatgaaatttctttttaatgcagaagatttcttatgtgaktaactgaatgggaattgatgctttgtggaatgaaatggattgagtacagagtgtgggatcaagaacttttaggcactgtgagtataagagggaaaccagg

SEQ ID NO: 30099 - DNA, 201 bp, Homo sapiens
gtcattctagtatcaactgagttctttataaaatatctttggggtgtttaaggagaattattctttttacaagttctgattaatgacaccgcaaaaatgaraataatgagctaatatgtatctagtaattgctatgcacttatatgtatagaagcgtataatccacagcactccttctgaatacgttacgtaaatggaacc

SEQ ID NO: 30100 - DNA, 201 bp, Homo sapiens
gtaaattgatgggtgggccacaaaaatcatgtcacaagatcttgttgatgtgcatgcattcattcattcaacaaatattattgagcatctaacataagccrggtgctttgctagggacagaatgctgtacaaggtccctgtcctcatggggaccgtatgttgggaagacagatgataggcatggaaatgaagagacaaacc

SEQ ID NO: 30101 - DNA, 201 bp, Homo sapiens
ggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatg

SEQ ID NO: 30102 - DNA, 201 bp, Homo sapiens
aacttggctgggtgcggtggctcacacctgtaatcttagcattttgagaggccgaggcgggtggatcacttgaggtcaggaattcaagaccagcctggccrccatggtgaagccccgtctctactaaaaatacaaaaaattagccagctgtggtggcacatgcctgtaatcccagctactcgggaggctgggacaggagaa

SEQ ID NO: 30103 - DNA, 201 bp, Homo sapiens
attggtaaatgaagtcagcttagtgatatgagaattatgaaacataaatccctttgtaaaaatataaaataatcttacaatcatcatcgtcatcctcatcrtcgtgttccttcacaccagcggtatttatggtatttatcaactaactgctgtgtactatgctctattgaaaatgttagcaatatagtaatgaacaaaaca

SEQ ID NO: 30104 - DNA, 201 bp, Homo sapiens
caactggagatggttgtcttcttttttattccatgaaacaaattgattaatgtgtcgagggagcaaggtggtacttatacctacccagcctgcttgtgtgkgtctcaaggtggagagaggctgtggaaacaatagagagaatagcatggaaggccacgttgcaattaaacaagattgggaaagaagacgggactaaaatca

SEQ ID NO: 30105 - DNA, 201 bp, Homo sapiens
attttcaactggagatggttgtcttcttttttattccatgaaacaaattgattaatgtgtcgagggagcaaggtggtacttatacctacccagcctgcttktgtgtgtctcaaggtggagagaggctgtggaaacaatagagagaatagcatggaaggccacgttgcaattaaacaagattgggaaagaagacgggactaa

SEQ ID NO: 30106 - DNA, 201 bp, Homo sapiens
agctcatgcctgtaatcccaacactttgggaggtcgaggcaggaggatctcttgaggctaggagctcgagaacagtctgggcaacatagcaagtctctgtstctacaaaaaatacaaaaattagctgcgcgtggtggcgcgtgcctgtagtcctagctactcaagaggctgacatgggaggattgattgagcccaagaggt

SEQ ID NO: 30107 - DNA, 201 bp, Homo sapiens
ctgaaaatgctgggattacacacatgaaccactgcgcccagccgctctactttattagatttaaaaagtttgctctcagctgggtgcagtggcttatgccwgtaatcccagcagtttgggaggccaaggcggggagggtcatgaggtcaagagatcaagaccatcctggccaacattgtgaaaccccatctctactaaaga

SEQ ID NO: 30108 - DNA, 201 bp, Homo sapiens
tagcaactcttcattgctgctttgcaaagaggatttgagattgtttatgtaggggcccgtgtataatacctcaagagaaaaagacacagatgaggctattrggattaagggaaaatcaagtaaatcgagaggtaaagcactgtgcagaaatattggccagaagctatgaacagttgccacagctgggctgaagagttacct

SEQ ID NO: 30109 - DNA, 201 bp, Homo sapiens
ttggatgtgcaatgtgaaatctcacaaattaaacatgttacataactgtattttgtttcctatctctgctgtaataaattttctcaatgttagtgacttakaaccacacaaaagttacactttacagttttggaggtcagtggtccaaaataggtctcagtgggctaaaatcgatgtgtcagcaggacaccatttctttct

SEQ ID NO: 30110 - DNA, 201 bp, Homo sapiens
cgtgagtattatgttttattttgctgggagaacaatttgggaaaatttgagcagcaaaccataagtttcttggtgtctgtgtacttggagctctgaatcaytattgtcactgagggagtggacaggaagtgatgctgagataagtctagatgggataggtgggcaacatgcaggagaaacctcctgggaaaggtgagcaag

SEQ ID NO: 30111 - DNA, 201 bp, Homo sapiens; identical to SEQ ID NO: 8567

SEQ ID NO: 30112 - DNA, 201 bp, Homo sapiens
gctagcaacctaagggagcttgaaggtgattgaccatccccagtcaagcctctgatgagaccgcagccccactaggcaactagatttcagcatggtaagamcctggatggagaacccagctcagccatgcccagactcctatcctatggaagctttaagataataaatgtatgtggctttaagctgttaagcttttggtaa

SEQ ID NO: 30113 - DNA, 201 bp, Homo sapiens
ctccactggaagaagagcctgtagaatatgcagactattcaaatgcttcctttggtccattgttgtcctttcttttctcttctagaactttccccatagtsatgcatctgtccctgggttatctgatatgtgtttcagcctgttttcccaagtttacctgcctctctgagaagcccatcagccctgagagatacctggaag

SEQ ID NO: 30114 - DNA, 201 bp, Homo sapiens
tgatccacctgcctcacctcccaaagtgctgggattacagtcgtgagccaccgtgccggccactttcatctttctgattaactgaaaagtatcaagcaatrcttacatgtaactgcactttctcatcaactgcaaccataatttagctatggatacaagagttgggcacaaatccatgaaagcattgagtgagaatcaatt

SEQ ID NO: 30115 - DNA, 201 bp, Homo sapiens
ttatgattctgcaagcgtggtttacactataaatttccaccggtctctgcttgtctcttctagaatttagggttattctcaaactctattatacaagcagygcccaagtgccttcctccaaaagtacattagatactttcttggggagagaagaaattagacaggagctacaaagatggattaaaattaatttggtcctaa

SEQ ID NO: 30116 - DNA, 201 bp, Homo sapiens
tgtttgcctatgctataaggcatcagtggttaccaggcagtgttgcattttttccatcccatacctctgtgtgtgttccttatctgtttctaggatgtgcyctctgccccgtcacatcacactctgtgctgctctcagccaaagctcttcttaaatacactagccatcaaaaccatacaacttggctgggtgcggtggctc

SEQ ID NO: 30117 - DNA, 201 bp, Homo sapiens
tccgttttgtgacttatttttaattattaagaataagtgtcataaagccaatactttctaacatgtgtatagtatgttatagttttcaaagtctttgacarttatacctagggagccaggacagtatttgtatcatcatttcattgttcctggaaaacaggttcagagaagttaagcgacttgcccaaaatagcacagcaa

SEQ ID NO: 30118 - DNA, 201 bp, Homo sapiens
aacctctctggcctcagtatctgtatctgtaatatggggaatcataaaagcacctacttgttaaggcatattaaatgcaacgctactttgaaggactcatrgtagttaacacccagtttggtaagtgttattattgaaggctgagaacagaacgacaaacaacaatcacaacaaaaggctggggaagattttcctggtggg

SEQ ID NO: 30119 - DNA, 201 bp, Homo sapiens
catccaccctcttggtactcaaagcttggtccatgaaccagcagcttcagcatctgctgagagcttgctggagatacagaatctcaggcctgactgacccsaggcctgctgagtctgaattttaaccagagtctcttggtgactcgtgtgtactttagaaggggaactgctcaccgcccccacttcccactgagtcgaata

SEQ ID NO: 30120 - DNA, 201 bp, Homo sapiens; identical to SEQ ID NO: 14795

SEQ ID NO: 30121 - DNA, 201 bp, Homo sapiens
tgcccaggctggtctcgaactactgggctcaagcaggccacctgcctcagcctccagaattgagattacaggcgtgagccactgcgcctagccaggagtaytttttagtagcagtcctagatagcttcactatcatttcctgggaaagttttggaaaccccagcagagccttcatctttaactgtgtgaccttgggccatt

SEQ ID NO: 30122 - DNA, 201 bp, Homo sapiens; identical to SEQ ID NO: 8568

SEQ ID NO: 30123 - DNA, 201 bp, Homo sapiens
gttttaggaagttgcatttaaaaaatcttggatacctgttttgtacatattatatatagcatcccgtgtgaatatgttaattcctttttatgagtttcggycttttttccctctcctatacatgattgctgttttatagctccagtttggtggaattaacatagatttcccacatggggaaggttttgggtgaggatttag

SEQ ID NO: 30124 - DNA, 201 bp, Homo sapiens
aatgtatgtgacttaatagcgtaatattttgtccattattttaaaacttgctttatttggtcaagacatacggaacacgtatagatcaaacaaaaattttkaaaaatgcttgcatactgctctgtgctgtggagtagccctaattaaatcaatcattcctctgtttatgggcattccatttcttttcaattttgatattat

SEQ ID NO: 30125 - DNA, 201 bp, Homo sapiens
tctctggtataaacttgagtcttctctttggtccctgataaatatacatagaatgtatggatgtgagaaagttaaactgatgtctgtgtgtcttcatgtcrttaaactttgaatctacggacatgtctttttctttctggcatagtttggaggtcttcattttgtgattgaatacaaaacaccgagggctttaaggaggca

SEQ ID NO: 30126 - DNA, 201 bp, Homo sapiens
agaacaactccttgctttttcaccaagaatctagaatctagaattatctgagcgttcgcatcagataactaggaagaaatcagagtcattttctctctaargcaggctcgatgatacctgcacagaagcagaggtttcccaagcatgcatgttactgcagtacaagatttggcattctgcatgttggggttgtttagaaac

SEQ ID NO: 30127 - DNA, 201 bp, Homo sapiens
ccctcaacctgttagaaacaagaaatgggactctggagtagatgttagcaacatcatgagctcaaacccctccagcttacagcggagacagtgaggtcctstaggatgaggttggagagcaggaacttgcccgaggtcatgtgcagagttcgaggcagggcctggatgggaagcccagcatggagaccccaggccgtctct

SEQ ID NO: 30128 - DNA, 201 bp, Homo sapiens
ttaatatttatcattgactaataatggtagagaaagtaatcatcataacctctgccctttattagtcactcatggtgtcacaagccctttacaaagcactktgcatgcaaatgattcctcataacaaccttgggaggtagttactttcattgtattagctatctcttgctgtgtaagaaattaccacaaatttagtatatt

SEQ ID NO: 30129 - DNA, 201 bp, Homo sapiens
cctctgtttctgtttcaactgcagagcctatttttctttcccttccagctcagctgccttctcctccctgacctcaggtcacccaagactcccactttatkatttccttttacttttagttcattattctctgtgattcagtggaaacataaaaaatggtttttaattttaattaatggcaaacttagaacagacccattt

SEQ ID NO: 30130 - DNA, 201 bp, Homo sapiens
tctgcatggcacagcacatggacatgattcatacatgcaagtgaatgagtgaatgggcgatttccagactatccagaaactgtgccccatagtcctacccrtaggaatccaacagggaactgtcaccaccgacccgaggcaggaaccatgtgctctgagccctggccattttgtgtagatggagataaattgtcattgcta

SEQ ID NO: 30131 - DNA, 201 bp, Homo sapiens; identical to SEQ ID NO: 4881

SEQ ID NO: 30132 - DNA, 201 bp, Homo sapiens
gccaaactgtgtgattctgtctgcagttgagaactgtaagaaaaagatcaagattaacattattattattggtgttacctcatgtctgtacctttttggasacgtgggtctgtttcccgagaaatcatttttcctcctccttgaaaatagtgaatttcaagtggttttaattttaactgcattatttgtttgctttatata

SEQ ID NO: 30133 - DNA, 201 bp, Homo sapiens
ggttcatctgtagaatatggacagccctctacaaattgggaacaagggccaggacacgaaatatagtgacagcctctggcctgggagtctagacagtggtsaaaggcaggattcatggagttttccaagataagattcaagacccaaactatgaatgaaagccaggctgaggctggcaccaagtagaggcctccaataatg

SEQ ID NO: 30134 - DNA, 201 bp, Homo sapiens
tgagaagttttccattccaaaccctttttaggagcggcctggaaactggagtcaactgtcaaatatgtccttatggccacaaagtatgctcatggattctsttttacaggcttagcataatattttataaaacatatttttaaagaaagtgtaattttcccccaaaagcaagggttttccaatgccatataatttactaag

SEQ ID NO: 30135 - DNA, 201 bp, Homo sapiens
gcacctactctgtgccaaagcactattgtaggctgtggagatagggagctgaagtactgaaagcgttacagtcaagggccagaaaaccattgttcaagcarttggcgtatggcttgatctgtgtttattacaaagcgatacttttccttctaagtactgctttacctgcatcctgcaaattttggtatgttgtattttcat

SEQ ID NO: 30136 - DNA, 201 bp, Homo sapiens; identical to SEQ ID NO: 14796

SEQ ID NO: 30137 - DNA, 201 bp, Homo sapiens; identical to SEQ ID NO: 8569

SEQ ID NO: 30138 - DNA, 201 bp, Homo sapiens
aaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcct

SEQ ID NO: 30139 - DNA, 201 bp, Homo sapiens
aaactggagtacttacccaccagatcctcatctgtcgttggttgaggactgctctcaggacattcacatccaggcacttctggtccacaccttggtacaayatttgcaatattagggacatgctaatacaattattcattgtatatgttaattcaaattaaatggaatgtcctatattttatagggcaaacttaggcttac

SEQ ID NO: 30140 - DNA, 201 bp, Homo sapiens
cctgctcaagttggtatgactggtgtatggtgccttaatgggtacttaaagtccaggtgagagtggcaggaggcagccaaatgcctaggtagataggagcyggtccctgttgaaaccccacttccaagttgaagacagtttaaagactgaaagccaagctacaagttaaatcctcggaccagattgagaacttgtcttctt

SEQ ID NO: 30141 - DNA, 201 bp, Homo sapiens
atgagacgttgcctttgaagtgtcggaaggatggagaggagaaaagaaaacggagattgaatctggaaaacgcattcatctttagaggcagtgttaatgartacatgaatttagtcctgtaaatgttttctcccttatttgggacttggtgtattgaaggtgtctgttaactgtgctaccaatgagtgcccctgtatccga

SEQ ID NO: 30142 - DNA, 201 bp, Homo sapiens
ggaaagtgtatagttctcctttccttacagaaacattattttgttattgttgtttgggtttgggtttctgaagtataaatgcatatgaactggacagaagkattatgcccatgtgccaggtggccaagatggggcttgtgatttgaagcttcttttcctagattcaggaaagtatcactggttaatcagggaatacatctt

SEQ ID NO: 30143 - DNA, 201 bp, Homo sapiens
gttttctgtcactattgatgaatttgcattttctagaattttagataagtgaagttttctagtacttgttctgcatctggtttctttcattccacataatkaccttgggatgtacccatactgctgcctgtatcagtggcttactcattgtcattggtgagtagtactccattgtgtggagaaatcacattgttttaaaaa

SEQ ID NO: 30144 - DNA, 201 bp, Homo sapiens
ttagtgtgatttgggatgaaaattttaaaaaatcaatatgtataatccaccatctttgttccttttatttttatgttactcattcttttaagcttgtcttrgacgtgagtattatgttttattttgctgggagaacaatttgggaaaatttgagcagcaaaccataagtttcttggtgtctgtgtacttggagctctgaat

SEQ ID NO: 30145 - DNA, 201 bp, Homo sapiens
gggattacaggcacatgccaccacacccagctttttgtatttttaatagagacaggatttcactatgttggccaggctggtctcgaactcctgacttcagrtggtctatccaccttggcctccccaaattctgggattacaggcatgagccaccgtgcccagccgtgtctgaccattttatcaggaaaagcaaaagctttt

SEQ ID NO: 30146 - DNA, 201 bp, Homo sapiens
taaaaataggcaatgaaactgaaaggcaatcaaagtctattgtcacaaggaatgggaggaacggggacgtgatctaacatttgctgagatcctgctgtatmccgggaacagaacatatatggtttcatttcatcctcccattatcaccgtgaggcctcttccgcttatctattgctgagtaacaaggtgtacccctcaatt

SEQ ID NO: 30147 - DNA, 201 bp, Homo sapiens
tcctcgtggtgatgttaagatgaaacaggaaggtgaggggcttaacacatttccgtgttcccataagctttcaggagatcttggtagttttcatctcggtsttcattaccatcatcactgcttcagactcctgtccatgtggggccctgtggtcttgcgatcacctccataaatgttcctttgttcccgcctaacacaata

SEQ ID NO: 30148 - DNA, 201 bp, Homo sapiens
tcctccagaggactgagatcctccagatgctgttcatttgccttattcgttatgaccatagaagtttgtggggtggcactctttattctgtcctcgccccrcaagcaaagcacacaccacaagctataaggagatgagctcagtaggcctgtcctttactttattttccctattagaatcccaccatagacgccctctctg

SEQ ID NO: 30149 - DNA, 201 bp, Homo sapiens
atgatttcatgggcccagccctgggtccctgtgctgtgtgtagcctagggacttggtgccctgtgtcccagccactccagtcatggctgaaaggggccaakgtatagctcaggctgtggcttcagagggtggaagccccaagccttggcagcctccatgtggtgttgagtgtgtgggggcacagaagtcaagaattggggt

SEQ ID NO: 30150 - DNA, 201 bp, Homo sapiens
ttttttaaaaggcaagatgttggcctggcgtggtggctcacgcctgtaatcccagcactttggcaggccaaggcgggtggatcacctaaggtcaggagttygagaccagcctgaccaacttggcaaaacccagtgtctactaaaaatacaaaaattagctgggcatggtgtcacatgcatgtagtcccagctactcaggag

SEQ ID NO: 30151 - DNA, 201 bp, Homo sapiens
ataaaatatctttggggtgtttaaggagaattattctttttacaagttctgattaatgacaccgcaaaaatgagaataatgagctaatatgtatctagtamttgctatgcacttatatgtatagaagcgtataatccacagcactccttctgaatacgttacgtaaatggaaccctcgcaacagtcttatccccattgtag

SEQ ID NO: 30152 - DNA, 201 bp, Homo sapiens
attcagcctgaaggcctacttgatgctgcaactgaaaaattgttagactagattttattttattttaattctttttgagacagggtcttagtctgtcaccyaggctgctggagtgcagtggtgcaatcatggctcactgcagtcttgaccaccctggctcaggtgatcctcccacctcagcctcccgggtagttagggcta

SEQ ID NO: 30153 - DNA, 201 bp, Homo sapiens
gtgagttagtgccatatatagcagtgttgtcagtaagatttctcactggcatctctgcttcccctcttgactctcttgaaatcccttcttcaggcagaagytggagtcatttctctaaaatagaaatctgatcttgccaccaccctacttgccactccctgcttaatcccttcactggctcaccatatcccttaggataaa

SEQ ID NO: 30154 - DNA, 201 bp, Homo sapiens
tagagcagttgtgtgttgaagaaagagaaggtggagtgatactgaataccccgtaaaatcacacaatcagcacttaagaatgttcacacagttgttcacamacatattgatatcagaccttatagcagtcctattggctagatcagttattatgaatgtgttttatagagtaggaaacagagatgcgacgtgacttgccta

SEQ ID NO: 30155 - DNA, 201 bp, Homo sapiens; identical to SEQ ID NO: 8570

SEQ ID NO: 30156 - DNA, 201 bp, Homo sapiens; identical to SEQ ID NO: 8571

SEQ ID NO: 30157 - DNA, 201 bp, Homo sapiens
gacatgagggctcaccccctcatctccaccgcagcagctctctgataaatgtagctctctgataaatgattctgttcctagtggtgtattcacagagtcartggataaggtggctggctttgcatttgagaagtatttgctttgtccaacagacaccagatgagtaacaatggaagtaggcagggtttgaagaggtatgtg

SEQ ID NO: 30158 - DNA, 201 bp, Homo sapiens
atctcttttcacgctgttgcattgaggagaggaaaaaatcccttaaatttgaattccatgtggatgctcttatttaatatgccgtttcaaagcctgtatgygatcaagccagagtattatcaggctctgagttcctgtgtgtattcccttggtccatgctccatctcaagtgtttctccacactgggataggcagcatatt

SEQ ID NO: 30159 - DNA, 201 bp, Homo sapiens
gaaaacggagattgaatctggaaaacgcattcatctttagaggcagtgttaatgaatacatgaatttagtcctgtaaatgttttctcccttatttgggacwtggtgtattgaaggtgtctgttaactgtgctaccaatgagtgcccctgtatccgagggaaactggagaagtgtacttgggctaccgggttaccaagagca

SEQ ID NO: 30160 - DNA, 201 bp, Homo sapiens
gatttcataagaaatccacatctgagagtcccagaaggtaagatattcccctttcttctaaatatacttgaccaccaccattcaggttcttctattaaccytcctatatttgccaaccctcaacctgttagaaacaagaaatgggactctggagtagatgttagcaacatcatgagctcaaacccctccagcttacagcgg

SEQ ID NO: 30161 - DNA, 201 bp, Homo sapiens
gagttgtcaggattctcgtaaaattcctgggtgatggcttcttctgttctctttatttccttaactgaacatctgtctaattgttcacctccatcgctttmgtgctttcctcatgctttctctctttccagacaataaactttattttcttcataagaattcagtctacgcaagggtattaggcagcttgtttgcaccttt

SEQ ID NO: 30162 - DNA, 201 bp, Homo sapiens
tagcttatagtttattttattctttaatgattttttaaaaatatttctctcacttacttgaaaagcagtcttagaaattaactggaatgggtaatttattygtctttcttcttttgtaaaataatggcagtttgtaactcagatttttgtatgaggaataaataaaatactgtctgttttcctttgatctttctatttgtg

SEQ ID NO: 30163 - DNA, 201 bp, Homo sapiens
ttttttgttagtttttgagacagagtctcggtctcttgcccaggctggaatgcagtggcacgatgttggctcactgcaaaccctgcctcccaggttcaagygattctcctctcccagcctcccgagtctctgggattacagacgtgcatcaccaggcccagctaatttttatatttttactcgagacgtagtttcaccatg

SEQ ID NO: 30164 - DNA, 201 bp, Homo sapiens
catgaatcgctgtgcctggcctcaactttaaatttttatattgaataatctttgatttgtattgtcatgttgttttatagcagttactgctgttttagtgkgatttgggatgaaaattttaaaaaatcaatatgtataatccaccatctttgttccttttatttttatgttactcattcttttaagcttgtcttagacgtg

SEQ ID NO: 30165 - DNA, 201 bp, Homo sapiens; identical to SEQ ID NO: 8572

SEQ ID NO: 30166 - DNA, 201 bp, Homo sapiens; identical to SEQ ID NO: 8573

SEQ ID NO: 30167 - DNA, 201 bp, Homo sapiens; identical to SEQ ID NO: 8574

SEQ ID NO: 30168 - DNA, 201 bp, Homo sapiens
caaggggaccaggaaatgctgaaagttcaggcctcggaaaggacaggatgtggaaggatgttctggactcaaggaggcctagggacccttggcaggaggcrttcatgggtctgtagtccaaggctccactaccatctccttggcttctctcttccattctagcttcttctgcttattcatcacttttgcttcctatgaaat

SEQ ID NO: 30169 - DNA, 201 bp, Homo sapiens
ctgactcttttaacttgtcaacatttcctacattcaacattgtactctaatatccagtaaagtgaaacaaacaaacaaataaatacacttttttcaagaamaaataaatatctgtgatctcatcatttgaccgtcagtattttcatttttgcatgtgccactttaatttccctaggcaacactagctagtggcccacaata

SEQ ID NO: 30170 - DNA, 201 bp, Homo sapiens
tgctttgaatgcaggcctgctgtttgcctgtggacctcaggatttgtaaggccatctccacccacctacagctaagtttcccaagagccgatctccagccraagtccaaggttccttgatgacccctgggaggagatgcaacacacagtttcctagaatcatttactccccaggctaagcacagtcacagaaatgaggtag

SEQ ID NO: 30171 - DNA, 201 bp, Homo sapiens
cccacgatcccatcttaatgtctgttgtggaagttggcccacagaagcctcaaggctaaccaacaagaaagatcacttcatatgcattagctggaaggtarcaagaggaaatcgcctgccagggtccctgactcccggaggaaagtgtcctctgagccctccttgagggacataaatagccccaaaagtcactgaatgcta

SEQ ID NO: 30172 - DNA, 201 bp, Homo sapiens
ctctctcagaatgaaaggtttgattcgtaccagctccccatcccttcccacgatcccatcttaatgtctgttgtggaagttggcccacagaagcctcaagsctaaccaacaagaaagatcacttcatatgcattagctggaaggtaacaagaggaaatcgcctgccagggtccctgactcccggaggaaagtgtcctctga

SEQ ID NO: 30173 - DNA, 201 bp, Homo sapiens
ctataaagttttagctagacagcgaatcaaggtggcaacacatggtgggttcttaaataatagttgtcatttgagtgctttctatatgatgtacatttcawtttgcactttacaaataacctcttcctttttctgtttaatcttaaaaaagatcccgggaggcaggcgttattgtgcccatttcctggataaggagaatga

SEQ ID NO: 30174 - DNA, 201 bp, Homo sapiens
ataggagactctttgaacacttttttaaaaggcaagatgttggcctggcgtggtggctcacgcctgtaatcccagcactttggcaggccaaggcgggtggwtcacctaaggtcaggagttcgagaccagcctgaccaacttggcaaaacccagtgtctactaaaaatacaaaaattagctgggcatggtgtcacatgcatg

SEQ ID NO: 30175 - DNA, 201 bp, Homo sapiens
cattcttctgcctagagtatgccttttccttcaccaaaccaagtggctctttcggaagacttgcctgaatcctagaccccttctctctacaaccttcagtstgagttgggtaccttgcatcctcctttgttcccatactaacccctacaaccatggtcattttgtggttatctgtttaattctctgctggctattccaggc

SEQ ID NO: 30176 - DNA, 201 bp, Homo sapiens
ggtggaattgttgtgtgagcctgtagagtccgtgttcttacccactgcatgatgtctgatcatcgtcaattttctttccatttggacagatgaatggtaayacttccctactaggtagagcaatgattccagaagtttataataattggaaagtgtattagtcgattctcacactgctataaagacattcctgagactggg

SEQ ID NO: 30177 - DNA, 201 bp, Homo sapiens
tgatgctagctgctataacaaataagcacgcctgtgcacagttgctcaaagatagtagaagtttatttcttgtttatgtaagatccataatgactcttgcyaattagcaggctgctctcttccaagtggtaacccagggactcaagctcttttcatcttgtggctcagccgtctgacacatgtggcttccagcactgccct

SEQ ID NO: 30178 - DNA, 201 bp, Homo sapiens
cggtccccatccacttgacccaccatacctcaagccacttctggctccatgctctttctttccttagggttttgaaacatgttcttcagcctagaatactsctcctccactcttaatttctacccatcctgcaaaactcagtctgaacagcacacgtcaaggaagcagttttggtctctcagattatatgaagctctccaa

SEQ ID NO: 30179 - DNA, 201 bp, Homo sapiens
actggctttttgagcctctagagtggcaggcgaactctgattttgaggaaaaaggatagggtaatggtgttgacacaggcactgttgaatacgtatgtacrtattttaatagttttctcattaatcaaatggaaatgctatcgattttataggatcgttgtgagaagaagtgagaattgaaatgaaaggcatctagtcttc

SEQ ID NO: 30180 - DNA, 201 bp, Homo sapiens
atggttgtcttcttttttattccatgaaacaaattgattaatgtgtcgagggagcaaggtggtacttatacctacccagcctgcttgtgtgtgtctcaagktggagagaggctgtggaaacaatagagagaatagcatggaaggccacgttgcaattaaacaagattgggaaagaagacgggactaaaatcatgccttgaa

SEQ ID NO: 30181 - DNA, 201 bp, Homo sapiens
aacaactaattaataaatatttgtgaatatagtgagtgactaaagtaatgcattaatggttgaatggctggccaccgtgcctcatgcctgtaatcccagcmctttgagaggccaaggcaggcagattacttgaggtcaggagttcaagatcagcctgggcaatatggtgaagccccgtctctactaaaaatagagaagtta

SEQ ID NO: 30182 - DNA, 201 bp, Homo sapiens
cttacgaagtcaaactctcagttaaatgtttatctagcaattcatttcttctgagccatctgttgctaggcaggatctgcagacctcttggttgcatgtgstgggttgggtcctccaagtctcttagcacaaagtcctgatgtttaaatcctgcaagcgaattgccacctttatttccaagttctcctcgaaatccacatt

SEQ ID NO: 30183 - DNA, 201 bp, Homo sapiens
cctgcctcagcctcccacagtgatgggattacaggcatgcgccaccatgcctggctaatttttgtatttttagtagagatggggtttcactatgttggccrggctggtctcgaactcctgggctcaagcaatgcactggccttggcctcccacattgctgggattacaggcgtgagccaccatgcctggccccctttcact

SEQ ID NO: 30184 - DNA, 201 bp, Homo sapiens
gatcatttgaaatctggaacattctttcctacggtggttgacttttcactgcctttgaggttctttccaagtaaaggcgttattctttgtggtgtgctccyggaggtcactaacaaaacgtctccagcaggtgttgtgtggattcccccaaatccgtaggctcttatttcctagacatgaagagtatgtgcgccttctttt

SEQ ID NO: 30185 - DNA, 201 bp, Homo sapiens
gtgtggcttgtaccttatattcactctatctaatcttcactctaaccatagaaggcaatactattatgctcattcataattaaggcaattgaagcccagayccttccagtagctttcctgaagtcaagttgccagtgcattggacatactaggctgtagttccagggcagcctggctctggtgtctttgctgcaatgacaa

SEQ ID NO: 30186 - DNA, 201 bp, Homo sapiens
gttctgttcgttgtaagatattgagtagcatccctgacctctgccccctggatgccagttcactttccaacaagttgcaacaagcagaaatgtctgtagayattagcagatgtctgctagcagttagaatggcctctggttgagaatcagagcagactctgctcacactgggctatcagggtatagttctctccctcccaa

SEQ ID NO: 30187 - DNA, 201 bp, Homo sapiens; identical to SEQ ID NO: 8575

SEQ ID NO: 30188 - DNA, 201 bp, Homo sapiens
gacattagtcctataaccacaaggaaatgagttctgctagcaacctaagggagcttgaaggtgattgaccatccccagtcaagcctctgatgagaccgcasccccactaggcaactagatttcagcatggtaagaccctggatggagaacccagctcagccatgcccagactcctatcctatggaagctttaagataataa

SEQ ID NO: 30189 - DNA, 201 bp, Homo sapiens; identical to SEQ ID NO: 8576

SEQ ID NO: 30190 - DNA, 201 bp, Homo sapiens
ttgaaattttttatactatgttctattgggaaccatttcagggttttgagatatagtatgatataataacagctatgctaaattctttgaagttattggtrgtggaatatcaatccagaatgaaaataaataattttggaaatgagcctgtcattgaaatatactttatttctcgttaaatgtcccagcaaaagtattttg

SEQ ID NO: 30191 - DNA, 201 bp, Homo sapiens
tgaactgaagtgctaatgtgaaatgttcatgatggtacccgagtacttgcggtggtacctagcgtgtgctttccaagtgctggcaaagaaaagaaaagaawtgcttggggctctgcctacctgtctaggctcctgtctggccattctctttcttgttccaaccatatcaaactcactgctgttgctaaaccttcctgtctc

SEQ ID NO: 30192 - DNA, 201 bp, Homo sapiens
tgactttaagccttaatgaaactaaggccggagcgggtggcacactccgtggctgggatccacagtgaaatctacgctgggagaggaggaatttagggtgrtaatttggttctttgctattgacgaaattttctaattgactggggttacttaataccagataatatttttttcttgctataaagagagtaaatttgtttt

SEQ ID NO: 30193 - DNA, 201 bp, Homo sapiens; identical to SEQ ID NO: 14797

SEQ ID NO: 30194 - DNA, 201 bp, Homo sapiens; identical to SEQ ID NO: 14798

SEQ ID NO: 30195 - DNA, 201 bp, Homo sapiens; identical to SEQ ID NO: 14799

SEQ ID NO: 30196 - DNA, 201 bp, Homo sapiens; identical to SEQ ID NO: 14800

SEQ ID NO: 30197 - DNA, 201 bp, Homo sapiens; identical to SEQ ID NO: 14801

SEQ ID NO: 30198 - DNA, 201 bp, Homo sapiens; identical to SEQ ID NO: 14802

SEQ ID NO: 30199 - DNA, 201 bp, Homo sapiens; identical to SEQ ID NO: 14803

SEQ ID NO: 30200 - DNA, 201 bp, Homo sapiens; identical to SEQ ID NO: 14804

SEQ ID NO: 30201 - DNA, 201 bp, Homo sapiens; identical to SEQ ID NO: 14805

SEQ ID NO: 30202 - DNA, 201 bp, Homo sapiens; identical to SEQ ID NO: 14806

SEQ ID NO: 30203 - DNA, 201 bp, Homo sapiens; identical to SEQ ID NO: 14807

SEQ ID NO: 30204 - DNA, 201 bp, Homo sapiens; identical to SEQ ID NO: 14808

SEQ ID NO: 30205 - DNA, 201 bp, Homo sapiens; identical to SEQ ID NO: 14809

SEQ ID NO: 30206 - DNA, 201 bp, Homo sapiens; identical to SEQ ID NO: 14810

SEQ ID NO: 30207 - DNA, 201 bp, Homo sapiens; identical to SEQ ID NO: 14811

SEQ ID NO: 30208 - DNA, 201 bp, Homo sapiens; identical to SEQ ID NO: 14812

SEQ ID NO: 30209 - DNA, 201 bp, Homo sapiens; identical to SEQ ID NO: 14813

SEQ ID NO: 30210 - DNA, 201 bp, Homo sapiens; identical to SEQ ID NO: 14814

SEQ ID NO: 30211 - DNA, 201 bp, Homo sapiens; identical to SEQ ID NO: 14815

SEQ ID NO: 30212 - DNA, 201 bp, Homo sapiens; identical to SEQ ID NO: 14816

SEQ ID NO: 30213 - DNA, 201 bp, Homo sapiens; identical to SEQ ID NO: 14817

SEQ ID NO: 30214 - DNA, 201 bp, Homo sapiens; identical to SEQ ID NO: 14818

SEQ ID NO: 30215 - DNA, 201 bp, Homo sapiens; identical to SEQ ID NO: 14819

SEQ ID NO: 30216 - DNA, 201 bp, Homo sapiens; identical to SEQ ID NO: 14820

SEQ ID NO: 30217 - DNA, 201 bp, Homo sapiens; identical to SEQ ID NO: 14821

SEQ ID NO: 30218 - DNA, 201 bp, Homo sapiens; identical to SEQ ID NO: 14822

SEQ ID NO: 30219 - DNA, 201 bp, Homo sapiens; identical to SEQ ID NO: 14823

SEQ ID NO: 30220 - DNA, 201 bp, Homo sapiens; identical to SEQ ID NO: 14824

SEQ ID NO: 30221 - DNA, 201 bp, Homo sapiens; identical to SEQ ID NO: 14825

SEQ ID NO: 30222 - DNA, 201 bp, Homo sapiens; identical to SEQ ID NO: 14826

SEQ ID NO: 30223 - DNA, 201 bp, Homo sapiens; identical to SEQ ID NO: 14827

SEQ ID NO: 30224 - DNA, 201 bp, Homo sapiens; identical to SEQ ID NO: 14828

SEQ ID NO: 30225 - DNA, 201 bp, Homo sapiens; identical to SEQ ID NO: 14829

SEQ ID NO: 30226 - DNA, 201 bp, Homo sapiens; identical to SEQ ID NO: 14830

SEQ ID NO: 30227 - DNA, 201 bp, Homo sapiens; identical to SEQ ID NO: 14831

SEQ ID NO: 30228 - DNA, 201 bp, Homo sapiens; identical to SEQ ID NO: 14832

SEQ ID NO: 30229 - DNA, 201 bp, Homo sapiens; identical to SEQ ID NO: 14833

SEQ ID NO: 30230 - DNA, 201 bp, Homo sapiens; identical to SEQ ID NO: 14834

SEQ ID NO: 30231 - DNA, 201 bp, Homo sapiens; identical to SEQ ID NO: 14835

SEQ ID NO: 30232 - DNA, 201 bp, Homo sapiens; identical to SEQ ID NO: 14836

SEQ ID NO: 30233 - DNA, 201 bp, Homo sapiens; identical to SEQ ID NO: 14837

SEQ ID NO: 30234 - DNA, 201 bp, Homo sapiens; identical to SEQ ID NO: 14838

SEQ ID NO: 30235 - DNA, 201 bp, Homo sapiens; identical to SEQ ID NO: 14839

SEQ ID NO: 30236 - DNA, 201 bp, Homo sapiens; identical to SEQ ID NO: 14840

SEQ ID NO: 30237 - DNA, 201 bp, Homo sapiens; identical to SEQ ID NO: 14841

SEQ ID NO: 30238 - DNA, 201 bp, Homo sapiens; identical to SEQ ID NO: 14842

SEQ ID NO: 30239 - DNA, 201 bp, Homo sapiens; identical to SEQ ID NO: 14843

SEQ ID NO: 30240 - DNA, 201 bp, Homo sapiens; identical to SEQ ID NO: 14844

SEQ ID NO: 30241 - DNA, 201 bp, Homo sapiens; identical to SEQ ID NO: 14845

SEQ ID NO: 30242 - DNA, 201 bp, Homo sapiens; identical to SEQ ID NO: 14846

SEQ ID NO: 30243 - DNA, 201 bp, Homo sapiens; identical to SEQ ID NO: 14847

SEQ ID NO: 30244 - DNA, 201 bp, Homo sapiens; identical to SEQ ID NO: 14848

SEQ ID NO: 30245 - DNA, 201 bp, Homo sapiens; identical to SEQ ID NO: 14849

SEQ ID NO: 30246 - DNA, 201 bp, Homo sapiens; identical to SEQ ID NO: 14850

SEQ ID NO: 30247 - DNA, 201 bp, Homo sapiens; identical to SEQ ID NO: 14851

SEQ ID NO: 30248 - DNA, 201 bp, Homo sapiens; identical to SEQ ID NO: 14852

SEQ ID NO: 30249 - DNA, 201 bp, Homo sapiens; identical to SEQ ID NO: 14853

SEQ ID NO: 30250 - DNA, 201 bp, Homo sapiens; identical to SEQ ID NO: 14854

SEQ ID NO: 30251 - DNA, 201 bp, Homo sapiens; identical to SEQ ID NO: 14855

SEQ ID NO: 30252 - DNA, 201 bp, Homo sapiens; identical to SEQ ID NO: 14856

SEQ ID NO: 30253 - DNA, 201 bp, Homo sapiens; identical to SEQ ID NO: 14857

SEQ ID NO: 30254 - DNA, 201 bp, Homo sapiens; identical to SEQ ID NO: 14858

SEQ ID NO: 30255 - DNA, 201 bp, Homo sapiens; identical to SEQ ID NO: 14859

SEQ ID NO: 30256 - DNA, 201 bp, Homo sapiens; identical to SEQ ID NO: 14860

SEQ ID NO: 30257 - DNA, 201 bp, Homo sapiens
aaatttgcctatctctgatgattagcaagattgataggcttttcttatgtcgggccatttgttttttaacgaattgccctttcatcttatatgcatgactrttggatatgtatcgattactaattgattgcttgcctcatgtgctataatttaattttcaaaatgtcccttagaagttaatttataaagtgtctattactt

SEQ ID NO: 30258 - DNA, 201 bp, Homo sapiens
agctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaaccca

SEQ ID NO: 30259 - DNA, 201 bp, Homo sapiens
gcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaa

SEQ ID NO: 30260 - DNA, 201 bp, Homo sapiens
gcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctac

SEQ ID NO: 30261 - DNA, 201 bp, Homo sapiens
ctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatg

SEQ ID NO: 30262 - DNA, 201 bp, Homo sapiens
ttattattattgttgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctactgtcagtgtgaacctgattagatctcaactgaaac

SEQ ID NO: 30263 - DNA, 201 bp, Homo sapiens
aagagaccaatttaaaacattctaatgagcatcatctcataatttggtaatctcatgtaaaatgcttataataggggtgtgtgtatgttatatatattttwaaaataaatttgtaatcatgtatacagtagtccccccttatccgtggtgtttcagtttttttttttttgagtcagagtattactctgttgcccaggctgg

SEQ ID NO: 30264 - DNA, 201 bp, Homo sapiens
gagaccatcctggctaacaaggtgaaaccccgtctctactaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgaga

SEQ ID NO: 30265 - DNA, 201 bp, Homo sapiens
actgagcaggaagggccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctat

SEQ ID NO: 30266 - DNA, 201 bp, Homo sapiens
agatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacgttacatgcaaatgt

SEQ ID NO: 30267 - DNA, 201 bp, Homo sapiens
caccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagagg

SEQ ID NO: 30268 - DNA, 201 bp, Homo sapiens
ggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctcca

SEQ ID NO: 30269 - DNA, 201 bp, Homo sapiens
aaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcact

SEQ ID NO: 30270 - DNA, 201 bp, Homo sapiens
ttatctttgggactgctataatgagatccacttagatctagctataatggaattttgtttagtggttctctgatttaaacatgacttttatccttttcagmtatcgtttcattaacatcactacctctttttaaatcctaatgttgtcatggaagcctgtgtaggggctgaccttgaagtctctgaaagctgaacactcag

SEQ ID NO: 30271 - DNA, 201 bp, Homo sapiens
ggcagcaccactgccatggaaattctccagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcctt

SEQ ID NO: 30272 - DNA, 201 bp, Homo sapiens
tcagtgggccccagttctttcaggtttaaggaataagcattttggtctatgaaaaatggggtttgcctaaagtataagattgtcttatatttataaatgcytgtgttcattgctgtgggttcactgctttctcttttgggcagccatataaataaaagaaccacctacttggacccaagactggcgtttactgtggatgat

SEQ ID NO: 30273 - DNA, 201 bp, Homo sapiens
gcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgtttt

SEQ ID NO: 30274 - DNA, 201 bp, Homo sapiens
aaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtat

SEQ ID NO: 30275 - DNA, 201 bp, Homo sapiens
gcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaaga

SEQ ID NO: 30276 - DNA, 201 bp, Homo sapiens
tattgacctatgtttttaattataactttgggtggtggtctgaaatgaaatgttaagtttgacgcaaaaataggactagtttgtgtaactgatttgttcaraataacagcttacatttctcagagctttttgtatgccaagtgctatgcgaaaccctggatgtacaatattcttatagtagcccctgagaccagtgctagg

SEQ ID NO: 30277 - DNA, 201 bp, Homo sapiens
cttattacctggtgacacgtgtttctagttattgacctatgtttttaattataactttgggtggtggtctgaaatgaaatgttaagtttgacgcaaaaatmggactagtttgtgtaactgatttgttcagaataacagcttacatttctcagagctttttgtatgccaagtgctatgcgaaaccctggatgtacaatattc

SEQ ID NO: 30278 - DNA, 201 bp, Homo sapiens
ttctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagc

SEQ ID NO: 30279 - DNA, 201 bp, Homo sapiens
ccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacacactggctgtcctcactgtca

SEQ ID NO: 30280 - DNA, 201 bp, Homo sapiens
gaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctga

SEQ ID NO: 30281 - DNA, 201 bp, Homo sapiens
gaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatct

SEQ ID NO: 30282 - DNA, 201 bp, Homo sapiens
agtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctgg

SEQ ID NO: 30283 - DNA, 201 bp, Homo sapiens
gggtcagttcaggcactgtgcgtaaagcacatagcaccgtgtctagtaggtactctctgttccttaactgtcgttccttgattgctcttaagatacgacartgcctcttatatcggcaccttagaatcacctaggaaatgtcctaaatacacgttttgggtctccatagagaacctactgtagccgactctcaactttggg

SEQ ID NO: 30284 - DNA, 201 bp, Homo sapiens
aaaatgggttgatatgagggtcagttcaggcactgtgcgtaaagcacatagcaccgtgtctagtaggtactctctgttccttaactgtcgttccttgattrctcttaagatacgacagtgcctcttatatcggcaccttagaatcacctaggaaatgtcctaaatacacgttttgggtctccatagagaacctactgtagc

SEQ ID NO: 30285 - DNA, 201 bp, Homo sapiens
ttttcacctgtaaaatgggttgatatgagggtcagttcaggcactgtgcgtaaagcacatagcaccgtgtctagtaggtactctctgttccttaactgtckttccttgattgctcttaagatacgacagtgcctcttatatcggcaccttagaatcacctaggaaatgtcctaaatacacgttttgggtctccatagagaa

SEQ ID NO: 30286 - DNA, 201 bp, Homo sapiens; identical to SEQ ID NO: 4969

SEQ ID NO: 30287 - DNA, 201 bp, Homo sapiens
ctgaggcagataaatcacctgaggttaggagttcaagaccagcctggctaacacggataaacctcgtctctactgaaaacacaaaaattagcttggcttcstggtgcatgcctgtaatcccagctactgcagaggctgaggcaggagaatcgcttgaacccaggaggcggaggttgcagtgagccgagatcgtaccattgc

SEQ ID NO: 30288 - DNA, 201 bp, Homo sapiens
gaattgtgcatttattattgctaggatgcatatacacattgaactcagtcaacttactctctctaaattatctcaccggtggagacattgcctcaggagtygagccctgtggtgtgcctcctgctgtcaccacatttgaccacctaactgaccccactgtggtcacctttgccacctgccctgctttggtcccttctctgc

SEQ ID NO: 30289 - DNA, 201 bp, Homo sapiens
tgtagtctcagcttcccagaaggtcaaggcaggaggattgctggagcccaggaggttgaggctgcagtgagctacaatcataccactgcactccagcctargcaacagagtgagaccttgtctcaaaaaataactggctgggcatggtggctcatgcctgtaatcccagcactctgggaggacgaggtgggcggatcacga

SEQ ID NO: 30290 - DNA, 201 bp, Homo sapiens
aaataaaagtaaataaggggaaattgcatactcctatctggactgttttcttatggttttggaatctctggcaggtagaagtaattatttctgtaactctyaggcagggcttaggaattatctcccttaggtttgacttctttctttcttgagaataagcgctgtgtttcgcaagagtaaagaagtggcatttattctgtt

SEQ ID NO: 30291 - DNA, 201 bp, Homo sapiens
gatcacttgagctcaggaattcgagaccagcctggccaacatggtgaaaccttatccgtaaaaaaaataaaaaattagccagacatcgtggtgcatgcctsttgtcccagctatttgggaggctgaggtgggaggattgcttaagcctgggagattgaggctgtagtgagctatgattgcaccactgcactccagcctggg

SEQ ID NO: 30292 - DNA, 201 bp, Homo sapiens
tttttgttcccccatgggatagtaggtaaattaatggaggaagggagtcaactaaacaatttatttgagcaattaatggaggaagggagtcaactaaacartttattagggctttatgtaaagccctagggttagttggttggttggttttgttttgttttgttcctttttttttttgccaggggatgctgtggttgaatt

SEQ ID NO: 30293 - DNA, 201 bp, Homo sapiens
cgcctcagcctcccaaagtcaggtgtgtctttatcagcagcattaaaacaaagtaataaaattggtttcttagggttggatggcttaaaacaacagaaatrtatcatctcacagttctgaaagtgagaagtccaaaatcaaggtgtcagcacagccacgttctttctgaaggctccagggatgatctactccatgcctttg

SEQ ID NO: 30294 - DNA, 201 bp, Homo sapiens
cactttattggtgatatggtttggctgtgtccccacccaaatctcatcttgaattgtagctcccataattcccatatgttgtgggagggaccgggtgggasaatattgaatcatgggggtggttcccccatactgttcttggggtagtgaatgaatctcatgagatctgatggttttataagggggaaacacctttcactt

SEQ ID NO: 30295 - DNA, 201 bp, Homo sapiens
tgcaattccctctcagtttacatcaaaatcagctcgtcacccttgagattgaagctcgcactctgtaagctctgaataaatattaaccatctcctgaaccytgaaggagacattttctggggagcagtgatttgatgatttgatgaagttgtgtgtgtgtgtgtagtttttcagacatatctccatctgattcttacctct

SEQ ID NO: 30296 - DNA, 201 bp, Homo sapiens
cattgacccacttatgtgtagtcccctagtgaaatgacaagaatccccagagctgggaaaacatttccatgcaattccctctcagtttacatcaaaatcakctcgtcacccttgagattgaagctcgcactctgtaagctctgaataaatattaaccatctcctgaaccctgaaggagacattttctggggagcagtgatt

SEQ ID NO: 30297 - DNA, 201 bp, Homo sapiens
ttatttaggaggggaatttggggacattgacccacttatgtgtagtcccctagtgaaatgacaagaatccccagagctgggaaaacatttccatgcaattmcctctcagtttacatcaaaatcagctcgtcacccttgagattgaagctcgcactctgtaagctctgaataaatattaaccatctcctgaaccctgaagga

SEQ ID NO: 30298 - DNA, 201 bp, Homo sapiens
cagaagaagttaaggtaaatggcttttagcacattgcacccccagcttttagcacattgcattatcattataataaatgtttacggttactgatattattwtagttctttatcgacattattacagtccattatttacagtccttatgttatttaggaggggaatttggggacattgacccacttatgtgtagtcccctag

SEQ ID NO: 30299 - DNA, 201 bp, Homo sapiens
aatgatgtgaggaagccaggaatgatgagtacctggattaaactaccttaaggctgattgagtaaaagtgaaagatcatcccgtcaactgctggcctgccrcttgtgttcgttaatagaacatttccctctgattgtcaggctttcttagcagctacagaatacttattttcttctttatattataagtttatgccactgc

SEQ ID NO: 30300 - DNA, 201 bp, Homo sapiens
attttcatttttattaagaagtaaggcaaaaacaaaataagacatatgtcagaacttcacttatccttctttgctgaattgtataatggttttaaaatacyaaaaaatatttcttcaatttttttctgctactcataatgtagcatctgtagagcgacacacttttgaatttgagttaatatttcctttttattttatttt

SEQ ID NO: 30301 - DNA, 201 bp, Homo sapiens
gacatgaatattggttgatattttcatttttattaagaagtaaggcaaaaacaaaataagacatatgtcagaacttcacttatccttctttgctgaattgkataatggttttaaaataccaaaaaatatttcttcaatttttttctgctactcataatgtagcatctgtagagcgacacacttttgaatttgagttaatat

SEQ ID NO: 30302 - DNA, 201 bp, Homo sapiens
atgttactgttttagctgcccccagtcaggtggttgatgagttggggagcctggtgggcagtctggaagagagcacagtgactgcaaggtcagctcctgaycttcataataaggactcacatgtgtcggtcccaaggatccccaagggatactcatggttgaaggtgtctatgtgttctccttggtgtccagcgaatgcct

SEQ ID NO: 30303 - DNA, 201 bp, Homo sapiens
tcttacccattagggattattaatatactagataagagtacagtctctggagctaggcttgtgactttgaacaaattattttatctctctgagctcagtcycctcatctacaaagggggaattgataataggaattgtcgcaaagagctgttttaaagattaaatgagataatagatataaagcacttagaagagagtttg

SEQ ID NO: 30304 - DNA, 201 bp, Homo sapiens
cttttgtgaccctgatgagattacaggtcctcagtctcctcattgtatctgaagactaaagaatcagaaatttgtgactccacttagtttttctccacccmggagccctcaggccgctggtgagtgaagttcttacccattagggattattaatatactagataagagtacagtctctggagctaggcttgtgactttgaa

SEQ ID NO: 30305 - DNA, 201 bp, Homo sapiens
aatctaggagaaaggtagagctctcttatgctggggcaacgctaccaacattggtattccacagcattccaacgattctaaatactctcccagagtagggmggaaaaatcatccaaactacttggtaattgaattcaagagtgatggaccaaaaattattaatgcattcccttccgtccaccagccaaagaggattccatc

SEQ ID NO: 30306 - DNA, 201 bp, Homo sapiens
ctctgttttcctacttttctttggccactgtttttgccacagcttctaggatttctctttcccacaatctaggagaaaggtagagctctcttatgctgggrcaacgctaccaacattggtattccacagcattccaacgattctaaatactctcccagagtagggaggaaaaatcatccaaactacttggtaattgaattc

SEQ ID NO: 30307 - DNA, 201 bp, Homo sapiens
catgcaatgttcacaggtctttacatgtaaaaacaaccctgtaaaataaataacattattctcttcattctccaagtaagctgaggcagaggattccagcrcaagcaatttggttccaaaacctgcccttttaacctctaccagattttggtgaactctctgtctttggaagggtaggtggcggctgcggggagaaataga

SEQ ID NO: 30308 - DNA, 201 bp, Homo sapiens
gtcaaagacatgaatattttcttctaagtagaagtaatgatgacgatgatggtagcagttatgagcaggtaacatgcattgaacacttatttgctccatgyaatgttcacaggtctttacatgtaaaaacaaccctgtaaaataaataacattattctcttcattctccaagtaagctgaggcagaggattccagcacaag

SEQ ID NO: 30309 - DNA, 201 bp, Homo sapiens
gaatattgggccgggcttggtggctcatgcctctaatcctacctgaagcaagagaatcgcctgaacttgggaggtagaggatgcagtgagctgagatggcrcccctgcactccagtctgggcaacagagcgaggctccatctcaaataaaattagtcagtcaaagacatgaatattttcttctaagtagaagtaatgatga

SEQ ID NO: 30310 - DNA, 201 bp, Homo sapiens
ttaatacctgttgcttttgtgtgcttcctatttaaaacatgtttatctatcccccacccccactttatccaaaagttattcagtgttttacaaagacatgmatattgggccgggcttggtggctcatgcctctaatcctacctgaagcaagagaatcgcctgaacttgggaggtagaggatgcagtgagctgagatggcac

SEQ ID NO: 30311 - DNA, 201 bp, Homo sapiens
gagctattttggaaattctgcacctcaatttctaaaaagttggaaggacaggaaaggggagctgtgtttgagatctcagaaatctgcaccccaccttgctrtccaccactggtattccgtcagtcttactaccccctcccacctctagcccaccctctaccatcctcaccaggaaggaggctgcattcatttcaagaactg

SEQ ID NO: 30312 - DNA, 201 bp, Homo sapiens
actggtgtggccgaaggagtgccgtgactcctctgccacctctccacatttggaagattgttttgcagctgcaacctcaaaacagaagcctcctaattacsaggtagctttctagagccaaacaaatgctgttgtttctgacaggtaaatcaagacagggaaatgatgacacattcaccacaactgaagtgttgatggggt

SEQ ID NO: 30313 - DNA, 201 bp, Homo sapiens
ggtgatgtttgaacttaagaatcaaaaacagtgcaagcgctgcatgggggagaacagtctaggcaaggtgaacggaagtgcagggtccctgaggcagaaargagctcagcctctttgttagctagaacaagaaaggggcccgtatggctagcataggatgggataggggatcgtggtggataccagctaggatttcactgt

SEQ ID NO: 30314 - DNA, 201 bp, Homo sapiens
aaactggtccttgtggaagcaacttcgggggaggaggaaagacagggaagaccattttaaggaggtgatgtttgaacttaagaatcaaaaacagtgcaagygctgcatgggggagaacagtctaggcaaggtgaacggaagtgcagggtccctgaggcagaaaggagctcagcctctttgttagctagaacaagaaagggg

SEQ ID NO: 30315 - DNA, 201 bp, Homo sapiens
aaggcctctgacttaacaggacttccgtgatgcgggggaagaagacaataggcaagtaagcaagtaaatatacaagataaatagaaactgtgatgagggarttaaagaaattaaactggtccttgtggaagcaacttcgggggaggaggaaagacagggaagaccattttaaggaggtgatgtttgaacttaagaatcaaa

SEQ ID NO: 30316 - DNA, 201 bp, Homo sapiens
tcatgtcatcctttggatgtcttgcagagctgagtgctgaaataaaatgataaacaagtcaaaaacaaaaaggcctctgacttaacaggacttccgtgatkcgggggaagaagacaataggcaagtaagcaagtaaatatacaagataaatagaaactgtgatgagggagttaaagaaattaaactggtccttgtggaagc

SEQ ID NO: 30317 - DNA, 201 bp, Homo sapiens
ttctcttctccttccaagaaaaaacacccataccattcttaacatctctggaagctgggggtcaggagagggagatccataaagttcttgtcttccccgaytcaagaagcttaagggtacattcactcactcatgaattgactggtttattcattcactggttgattaattcattcattcactggttaattaattaattca

SEQ ID NO: 30318 - DNA, 201 bp, Homo sapiens
tcccctcctctccagccctcacctggttttctcttctccttccaagaaaaaacacccataccattcttaacatctctggaagctgggggtcaggagagggrgatccataaagttcttgtcttccccgactcaagaagcttaagggtacattcactcactcatgaattgactggtttattcattcactggttgattaattca

SEQ ID NO: 30319 - DNA, 201 bp, Homo sapiens
tggtgtggccatggttctcgtacttcaggtccctgtgagcccctggggtcctacacaacttggggtaatgctatggtcacctgcatcccctcctctccagycctcacctggttttctcttctccttccaagaaaaaacacccataccattcttaacatctctggaagctgggggtcaggagagggagatccataaagttct

SEQ ID NO: 30320 - DNA, 201 bp, Homo sapiens
gggaaggagaagggcctttgggactgggtggatgtaacactttctgccacctctactcttcctgctatagattaaaacagaagctctgaattgcagccacwaatcaataatgaaaagctaccagaccaagccctttcttgtttagtgttgtgtcttctgtgtcaacatctctggaacatagtcaatggcagtacccagtag

SEQ ID NO: 30321 - DNA, 201 bp, Homo sapiens
cctaaccaggatgtgagagacattcttgtcctaggcagcacgttggtggcagaggtgggatctagactgaggctctcattctgtaccctctctggccccarggaaggaaaggggaaggagaagggcctttgggactgggtggatgtaacactttctgccacctctactcttcctgctatagattaaaacagaagctctgaa

SEQ ID NO: 30322 - DNA, 201 bp, Homo sapiens
tcacaagtctatgaatagagtatattacccacttcattttaagtaggaaattgaagctcagggaatcgtagcagagggccccagttcacactgctgatcartgatgcgactgggatcaccacagcccatctggttcagaagcttgttctcctaaccaggatgtgagagacattcttgtcctaggcagcacgttggtggcag

SEQ ID NO: 30323 - DNA, 201 bp, Homo sapiens
tcccaggctggagtgcagtggcatgatcttggctcagtacaacatctgcctccctggctcaagggatcctcccatctcagcctcctgagtagctgggactrcaggtgcatgccaccacacctggctaacttttatttatttttagtagagaggcagttttgctgtgttgcccagactggtcttgaactcttgagctcaaga

SEQ ID NO: 30324 - DNA, 201 bp, Homo sapiens
aataaaaccaatgagcttaatctacttgtggaatgttatagccggaagggattcatagagatcactctatcgcctaaaattctctcttctacatatctcastgttggaaaacataaatgtgactccaacttgtcttttttgttgtttgtttttgagacagggtctttgtttcccaggctggagtgcagtggcatgatcttg

SEQ ID NO: 30325 - DNA, 201 bp, Homo sapiens
tccatctatttcaggggatgaccagtctgaataaaaccaatgagcttaatctacttgtggaatgttatagccggaagggattcatagagatcactctatcrcctaaaattctctcttctacatatctcactgttggaaaacataaatgtgactccaacttgtcttttttgttgtttgtttttgagacagggtctttgtttc

SEQ ID NO: 30326 - DNA, 201 bp, Homo sapiens
tgtgaaatgggaacatgacttaccatctactcacctcctgtttgagttcaagggaaggtttgcagattggcctgaaggaagacttctcttgaaaaactcawaccaaagagcacaccgccgtccccaaccctgagccatttctgtccttttcatggaaagggaactgtgttcgccagctcgtaaagccccggcgtctcctcc

SEQ ID NO: 30327 - DNA, 201 bp, Homo sapiens
agttttctcatctgtaaaatggagatcgcagtatctaactcatgggtgtgtttaaggattcagtgatggagaaaatagctgaaaagtgaccgtatgaaatragcagcagttgtcaagtacttggcatagttcctgtcacataggaagcatccagtaagtagtggtatctgttgtgattatgatcatattttatttcatgga

SEQ ID NO: 30328 - DNA, 201 bp, Homo sapiens
ccgcagctcctgtagtagttatggtcactgactccgggttcagacggacttggggttcagtcctagctctggcgcttaccagttttctcaagtgactttgrgcatctttactcaaggctcttggtctcagttttctcatctgtaaaatggagatcgcagtatctaactcatgggtgtgtttaaggattcagtgatggagaa

SEQ ID NO: 30329 - DNA, 201 bp, Homo sapiens
ccaaggaaatgaccagcacgtggctcactccctgtctgtccagtagaggacaccaaggcacgatgaccgcagctcctgtagtagttatggtcactgactcygggttcagacggacttggggttcagtcctagctctggcgcttaccagttttctcaagtgactttgagcatctttactcaaggctcttggtctcagttttc

SEQ ID NO: 30330 - DNA, 201 bp, Homo sapiens
ttttctagaaggtggtattttgcatattaatacttgcttaaatcaagaagctaagactttgtattatattttgctttacgtgccttgattaaggtcatgaycctgacattccagtcccaaaggagaccaaggaaatgaccagcacgtggctcactccctgtctgtccagtagaggacaccaaggcacgatgaccgcagctc

SEQ ID NO: 30331 - DNA, 201 bp, Homo sapiens
tcttctttagaagtcatcaatggtaagcctagggcagcctgaaccacttgtgttagaaatattttttataaagcaggacatgtgctttgaaatttgattcstccgtcactggctgtgtgaccttaaagaaataaattgacctgcctgagcctctcggaaatattggctggccagtagcatcctcacagagtttttctggga

SEQ ID NO: 30332 - DNA, 201 bp, Homo sapiens
ctgtacaaaaaatataaaaatgagctgggtgtggtggcacatacctgtagttccaactgctcagaatgctaaggtaggagaatcgcttgaacccaggaggyggaagttgtagtgagccaagatcgcatcactgcactccagcctgggtgacagagtgagactccatctgaaaaaaaaaaaaaaaaaaagacatttacattt

SEQ ID NO: 30333 - DNA, 201 bp, Homo sapiens
ggtggctcacgcctgtaatcccagcactttgggaggccggggcaggcagatcatgaggtcaagagatcaagagcatcccggccagcatggtgaaaccctgyctgtacaaaaaatataaaaatgagctgggtgtggtggcacatacctgtagttccaactgctcagaatgctaaggtaggagaatcgcttgaacccaggagg

SEQ ID NO: 30334 - DNA, 201 bp, Homo sapiens
ctaaaaaggtaatcattttataagtacctattatgtgccagatactaggataggcactttgcatagaaactcacatttcgactgggcctggtggctcacgyctgtaatcccagcactttgggaggccggggcaggcagatcatgaggtcaagagatcaagagcatcccggccagcatggtgaaaccctgtctgtacaaaaa

SEQ ID NO: 30335 - DNA, 201 bp, Homo sapiens
ccaaaccataccactcatggcatctcgtttttacagagtatatgtgttttcagattttgcatgacattttaggataaatgtgatgaaaatgaggaaaattrggaatgaagtttaggtcagaaaagtttcagtgattattttttcagaatcattgtttcttggtttctagggtccaacatgccattgttcaatggctgtatt

SEQ ID NO: 30336 - DNA, 201 bp, Homo sapiens
tcaagatgagtgttatttggcagaggaagatgatgcactgcttattttaggggatgccctcacttttgggtccctatgtcacctgtgtgtactccatgccrgtgtcttcccagcccctgccaggcaagttcgtgtggttctgtgataaccctcatctctataggttctgtgataacgctcctctcactgtgctgctccttg

SEQ ID NO: 30337 - DNA, 201 bp, Homo sapiens
gttttaagccagagagagattgataagacatggaatgatatggtgtgatatatgaaatgacatgtttgaaatgatagatgacgtgattgtgatataatatsatgcggctgaggacaacactataactgctcggtagagaatggattgtcatggcctgggtgtggtggctcataatcccagcactttgagagctccaggtgg

SEQ ID NO: 30338 - DNA, 201 bp, Homo sapiens
attggcttggctcggtggttgggatggtttggctcttactgggcagtaagcacagtggctgggataggaccttggcatctcgtgcgaagcccctctgcctkgagtcctgcctctgtgacacttgcttactgtgtgacctgggtcaactcatacctactgttcgtcagttttctcatctgtaaaatggggattccagtggtt

SEQ ID NO: 30339 - DNA, 201 bp, Homo sapiens
ctgctccaatgaggatgaaaatgtctttcttatagatgggacaggagccttagtaatatggtgcgagcaatggttcacataggggacaggtgttcattcartggtgggtattattataataatcattagcatcattgctagtgactttatttttcctttagccaatggagcagtggcttttggcccactactttcgactga

SEQ ID NO: 30340 - DNA, 201 bp, Homo sapiens
gagaagaagagtgacagagtcaccaactcactccatcaaatgtggctgtatttttagaagtgtctggttcctgaaatacctcaattccttttgcctgcctrgctcctctcctctcttctgcctgttcattgaactgaaagattatcaggactgtattcagcccggccaataatatcacaaaacaaaaatatcttgtgggtt

SEQ ID NO: 30341 - DNA, 201 bp, Homo sapiens
actgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcc

SEQ ID NO: 30342 - DNA, 201 bp, Homo sapiens
cgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctc

SEQ ID NO: 30343 - DNA, 201 bp, Homo sapiens
gcactttgggaatacgaggtgggccaatcactgaggtcaggagttcgagaccagcctggccaacatggtgaaaccccgtctctactaaaaatacaaaagtkagtcggggttggtggtgtgctcctgtagttccagctacttgggaggctgaggcaggagaatcacttgaatccgggagccagcggttgcagtgagcttaga

SEQ ID NO: 30344 - DNA, 201 bp, Homo sapiens
aataaaaaataaaataaaaaaataaaaataaaaataaataaaaagtagttgggcgtgtgttgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagt

SEQ ID NO: 30345 - DNA, 201 bp, Homo sapiens
atcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaagcaggaggatcgcttgagctcaagaggttgaggctgctgtgagctatgatctcacctctgt

SEQ ID NO: 30346 - DNA, 201 bp, Homo sapiens
gagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggt

SEQ ID NO: 30347 - DNA, 201 bp, Homo sapiens
attaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaaga

SEQ ID NO: 30348 - DNA, 201 bp, Homo sapiens
actaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaac

SEQ ID NO: 30349 - DNA, 201 bp, Homo sapiens
tagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctt

SEQ ID NO: 30350 - DNA, 201 bp, Homo sapiens
cctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttactt

SEQ ID NO: 30351 - DNA, 201 bp, Homo sapiens
ggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgg

SEQ ID NO: 30352 - DNA, 201 bp, Homo sapiens
ggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttga

SEQ ID NO: 30353 - DNA, 201 bp, Homo sapiens
cttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaataca

SEQ ID NO: 30354 - DNA, 201 bp, Homo sapiens
agatgaggttcttgagtactttcaattaggtttaccactgaccccatcagtgtgcagacgaagggagatgagagatacagatggttaatgggatttttggrgtatcttccagcctttgtgagcacagaggtttcgctacattttgaaaattaaaattcatttcattcgcattacagattttaaatcctagctcctttttaa

SEQ ID NO: 30355 - DNA, 201 bp, Homo sapiens
cagatgaggttcttgagtactttcaattaggtttaccactgaccccatcagtgtgcagacgaagggagatgagagatacagatggttaatgggatttttgkggtatcttccagcctttgtgagcacagaggtttcgctacattttgaaaattaaaattcatttcattcgcattacagattttaaatcctagctccttttta

SEQ ID NO: 30356 - DNA, 201 bp, Homo sapiens
tcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgacc

SEQ ID NO: 30357 - DNA, 201 bp, Homo sapiens
atcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaa

SEQ ID NO: 30358 - DNA, 201 bp, Homo sapiens
gccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggc

SEQ ID NO: 30359 - DNA, 201 bp, Homo sapiens
aggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatg

SEQ ID NO: 30360 - DNA, 201 bp, Homo sapiens
agtagatattggaaatatgaacccaatatgttcttaacatctccatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaa

SEQ ID NO: 30361 - DNA, 201 bp, Homo sapiens
ttcaacacagttctcttgtctctgttcatgatataacagtaaatccaagttgctttaagtagatattggaaatatgaacccaatatgttcttaacatctcyatgtcgtaattctaatttaaaatcaaaatctcatcaaattacattttagattaaaggattgtacctatcgaaagaagagaatcgaaaatgcgaaagtcct

SEQ ID NO: 30362 - DNA, 201 bp, Homo sapiens
ttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctccatgtcgtaattctaattta

SEQ ID NO: 30363 - DNA, 201 bp, Homo sapiens
aaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagt

SEQ ID NO: 30364 - DNA, 201 bp, Homo sapiens
tttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagagg

SEQ ID NO: 30365 - DNA, 201 bp, Homo sapiens
agatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagt

SEQ ID NO: 30366 - DNA, 201 bp, Homo sapiens
cctgggaaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatg

SEQ ID NO: 30367 - DNA, 201 bp, Homo sapiens
atacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatgga

SEQ ID NO: 30368 - DNA, 201 bp, Homo sapiens
ttagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccg

SEQ ID NO: 30369 - DNA, 201 bp, Homo sapiens
taatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatga

SEQ ID NO: 30370 - DNA, 201 bp, Homo sapiens
cacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctat

SEQ ID NO: 30371 - DNA, 201 bp, Homo sapiens
ggtcaggcagctgtttgacaggattcttgcaaatgtttttggtttctctgtctactcattacgtacactctgccagaggttgaaaactcaatgttgagatyacatacatcctgaaaacactgtttaaataaaattttggcctgcatcctgtttttgaaaacttgcaatggcttgccaacgttttcaagttgagaagtttca

SEQ ID NO: 30372 - DNA, 201 bp, Homo sapiens
ttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcat

SEQ ID NO: 30373 - DNA, 201 bp, Homo sapiens
gtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgttta

SEQ ID NO: 30374 - DNA, 201 bp, Homo sapiens
ttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaaccc

SEQ ID NO: 30375 - DNA, 201 bp, Homo sapiens
gatagcatgagactgtgtctcaaaaattaaaaaataaaacataaataaatttctattgttttaagacaatttgcctgtggccctaggaaaccagtatagayaacttgtgatggtttagcttatttagtacaacaaccctgccccttctagtttttatgataacctcattaattgccggtactctcagagccctgattttct

SEQ ID NO: 30376 - DNA, 201 bp, Homo sapiens
aacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagc

SEQ ID NO: 30377 - DNA, 201 bp, Homo sapiens
gaagctttacccctgagaagagcaggcatcagatgggctttggaatctacatgggtgtttgtaggtagaccatcctggaagttgagtgatggggaataaarggaagaaagtgcattctgaacagagggaatagcaggtacagcagctcagacatgggcaccttcagagcgtgtctgagtcttcctgatgagacacgtggtg

SEQ ID NO: 30378 - DNA, 201 bp, Homo sapiens
gacagcagggggtgaggataagaaggaggaagctttacccctgagaagagcaggcatcagatgggctttggaatctacatgggtgtttgtaggtagaccaycctggaagttgagtgatggggaataaagggaagaaagtgcattctgaacagagggaatagcaggtacagcagctcagacatgggcaccttcagagcgtgt

SEQ ID NO: 30379 - DNA, 201 bp, Homo sapiens
tcagttttcgtgtctccctcccactggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgag

SEQ ID NO: 30380 - DNA, 201 bp, Homo sapiens
tatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattat

SEQ ID NO: 30381 - DNA, 201 bp, Homo sapiens
gctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttt

SEQ ID NO: 30382 - DNA, 201 bp, Homo sapiens
gcttcagggaagggcagtgcaaattgtttctggactgatgccatcttttaataatagtagttaatagactgggtacaatggctgacgcccgtaatcccagygctttgagaggccgaggccggtgtatcgcctgagtccaggagttagagaccagcctgggcaaacagcctgaggcaaaacctcatctctacaaaaaataca

SEQ ID NO: 30383 - DNA, 201 bp, Homo sapiens
cccaggctcaactatcagccgccttctcatcccaagggctgtcaccaccagaaatttaacatgctgttagtgcatgcaaaaaaaagcccagtaattgtagsgctcatcagtacattgttaattgatcctcatttcctattattttacctcaaagcaaacacatcattcaccatagtgacaccagagttgtttatcttctct

SEQ ID NO: 30384 - DNA, 201 bp, Homo sapiens
ctcttacttaaacacacagcatgactctccttacacatttatttcagaagagcaaagtccgggtccccaggctcaactatcagccgccttctcatcccaasggctgtcaccaccagaaatttaacatgctgttagtgcatgcaaaaaaaagcccagtaattgtagggctcatcagtacattgttaattgatcctcatttcc

SEQ ID NO: 30385 - DNA, 201 bp, Homo sapiens
cttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctg

SEQ ID NO: 30386 - DNA, 201 bp, Homo sapiens
accttcaccaccacccaatgtgtcctgctcatcactgaggtttgtcatttttactctgagtctgtccattgtcatcatctccaccatcaccccttttgttytcattgccacccttgcctggggtgagtgaagacgctcttctctggcttccacccttccaaatgcccttaacccacagatgggaagaaaatgaggtggggg

SEQ ID NO: 30387 - DNA, 201 bp, Homo sapiens
atgagcgttttgcttcgtgtactcatttatttctgaaaataatgcagccccttgtagggctttctggctaattgagtggtgccatcattcatgcagttgcrcaattcacacaccaggctgccactttggcccctgcgtcaccttcaccaccacccaatgtgtcctgctcatcactgaggtttgtcatttttactctgagtc

SEQ ID NO: 30388 - DNA, 201 bp, Homo sapiens
ggtggatgagcgttttgcttcgtgtactcatttatttctgaaaataatgcagccccttgtagggctttctggctaattgagtggtgccatcattcatgcarttgcacaattcacacaccaggctgccactttggcccctgcgtcaccttcaccaccacccaatgtgtcctgctcatcactgaggtttgtcatttttactct

SEQ ID NO: 30389 - DNA, 201 bp, Homo sapiens
agggtgcttatgaggaaggtttcctactcctaaaagagatacacaggaagagagaccttctgcttcctctggacactggcgcagcctggactagcagttgscagcttgggtttggacaacctccgaccttagttgaaaatgaccctgtgtaggacagaggagcaagtggaaagaacctgggtgcattgtggcattttagag

SEQ ID NO: 30390 - DNA, 201 bp, Homo sapiens
tccctagtgttggatagctaggccatttataatttggacactattttaaaaaataactcaggcttattttactatttatttttgccttacactttttgtamaagtaatcagagcagtaataatagatgactccccaaaatccttttgcctctaatgattagtctaagcccataatgctgtgttccttgccagtgattggtt

SEQ ID NO: 30391 - DNA, 201 bp, Homo sapiens
aagattacaccatgtaaatgaattgtattttatgtaaccattccctagtgttggatagctaggccatttataatttggacactattttaaaaaataactcrggcttattttactatttatttttgccttacactttttgtaaaagtaatcagagcagtaataatagatgactccccaaaatccttttgcctctaatgatta

SEQ ID NO: 30392 - DNA, 201 bp, Homo sapiens
tcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcaggcttat

SEQ ID NO: 30393 - DNA, 201 bp, Homo sapiens
acttggtaaagaagcagatatttctttaatacgtgtatatattagactgtgaatttattcatcttccttattcatcatataagtaaattatatgattggayccaggcataaaacgtgatttgactcccccttgcccatcacagttctggagttcacatatcatttgttactttgaaaaatgaacttttgttatttgattat

SEQ ID NO: 30394 - DNA, 201 bp, Homo sapiens
aggttcttctgtgataaaaatagacttggtaaagaagcagatatttctttaatacgtgtatatattagactgtgaatttattcatcttccttattcatcayataagtaaattatatgattggacccaggcataaaacgtgatttgactcccccttgcccatcacagttctggagttcacatatcatttgttactttgaaaa

SEQ ID NO: 30395 - DNA, 201 bp, Homo sapiens
cccctgtttcaaatgaatacagattcattttgtcacctgtgtgaaattggtgtccgtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggt

SEQ ID NO: 30396 - DNA, 201 bp, Homo sapiens
aatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccatgcaatgcttgagatttgccctgtgactcaacccaaatctaaagcccgagtcgta

SEQ ID NO: 30397 - DNA, 201 bp, Homo sapiens
gggtattactctgttgcccaggctggtgttgaactcctggcctcaagcgatcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactc

SEQ ID NO: 30398 - DNA, 201 bp, Homo sapiens
acactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcg

SEQ ID NO: 30399 - DNA, 201 bp, Homo sapiens
atgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcg

SEQ ID NO: 30400 - DNA, 201 bp, Homo sapiens
cccacacttactcttattcacccagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctataca

SEQ ID NO: 30401 - DNA, 201 bp, Homo sapiens
tggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaaaatagtctgcagggtgactcagaag

SEQ ID NO: 30402 - DNA, 201 bp, Homo sapiens
gcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagc

SEQ ID NO: 30403 - DNA, 201 bp, Homo sapiens
aatctggagtccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatga

SEQ ID NO: 30404 - DNA, 201 bp, Homo sapiens
taaattttatttttcagtttacttggttttgcctccttctagaactagaacataagctctctgaagtcagggaccatgcctagaatcgccttccttttatytcccatcagccgaaactaactctgctgtgtcacgctgtgttaggctgtgttggctgtgagtaagagaagtctcacccaactagctgaagcgaggtgggtt

SEQ ID NO: 30405 - DNA, 201 bp, Homo sapiens
tgattttgatttggttgtttttggtagagatgatatcttgctctattgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctcc

SEQ ID NO: 30406 - DNA, 201 bp, Homo sapiens
atctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtgctgggattataggtgtgagccagtacacttggccttttggcacc

SEQ ID NO: 30407 - DNA, 201 bp, Homo sapiens
ccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactg

SEQ ID NO: 30408 - DNA, 201 bp, Homo sapiens
cccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaa

SEQ ID NO: 30409 - DNA, 201 bp, Homo sapiens
ctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaa

SEQ ID NO: 30410 - DNA, 201 bp, Homo sapiens
aacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctaggtttatgtatggattaacacagtgatagaccct

SEQ ID NO: 30411 - DNA, 201 bp, Homo sapiens
ggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttc

SEQ ID NO: 30412 - DNA, 201 bp, Homo sapiens
gtgtttttttttttttttttagatttctcattgctgagaacagttccagctctgctgaccaaaggctgagtgtccttttattagtctgagcccctagagaraccaaagaggcaaccctcgagccaactgacagccagctgtggggttggaccctgtttttcatacagtgagcactcttgaacccagagaaggtgcaggttg

SEQ ID NO: 30413 - DNA, 201 bp, Homo sapiens
aattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagt

SEQ ID NO: 30414 - DNA, 201 bp, Homo sapiens
caaaccaccaaacctgggttggcgtttcagtgcctgacacagttgtattcctaagacatagttgggaccagacctcaagaaaatagccaacaaatactggstgaatgaacgaaagaggccatatgcagtcagcccccctctctctgggttctacatatgtagatttaactaatgacagattaaaagcattcgaacaaacgg

SEQ ID NO: 30415 - DNA, 201 bp, Homo sapiens
ctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaacc

SEQ ID NO: 30416 - DNA, 201 bp, Homo sapiens
agaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgt

SEQ ID NO: 30417 - DNA, 201 bp, Homo sapiens
agacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaaccc

SEQ ID NO: 30418 - DNA, 201 bp, Homo sapiens
tttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacctgattggccacctagtctggtcttaaagtcccaaaggga

SEQ ID NO: 30419 - DNA, 201 bp, Homo sapiens
aagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggag

SEQ ID NO: 30420 - DNA, 201 bp, Homo sapiens
gatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaac

SEQ ID NO: 30421 - DNA, 201 bp, Homo sapiens
tttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagca

SEQ ID NO: 30422 - DNA, 201 bp, Homo sapiens
tacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagag

SEQ ID NO: 30423 - DNA, 201 bp, Homo sapiens
aggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccat

SEQ ID NO: 30424 - DNA, 201 bp, Homo sapiens
atgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaa

SEQ ID NO: 30425 - DNA, 201 bp, Homo sapiens
tattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaa

SEQ ID NO: 30426 - DNA, 201 bp, Homo sapiens
tttaacaagagacacatgtcagatagtagacatgatctgagaagacacaaaacccagcgtggtgattttggcagccttgccatgcatctctaacatgcacrtggccagaaaaatagcttggacattctgttcaaccctccacatcaactggtcagtttagtctttaaaaggtgataggcctgttgtggtggctcacgcctg

SEQ ID NO: 30427 - DNA, 201 bp, Homo sapiens
aaagtccgcacttcctaatgttaccactctggaggttagaatttcaacatataaattttggggggacacattcagaccacaataatgttttataatgttcmttttgctttaacaagagacacatgtcagatagtagacatgatctgagaagacacaaaacccagcgtggtgattttggcagccttgccatgcatctctaac

SEQ ID NO: 30428 - DNA, 201 bp, Homo sapiens
ggaagccttcactctcatgacataattacctcccaaagtccgcacttcctaatgttaccactctggaggttagaatttcaacatataaattttggggggasacattcagaccacaataatgttttataatgttcattttgctttaacaagagacacatgtcagatagtagacatgatctgagaagacacaaaacccagcgt

SEQ ID NO: 30429 - DNA, 201 bp, Homo sapiens
tggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctgg

SEQ ID NO: 30430 - DNA, 201 bp, Homo sapiens
aaagaggtgtaaatggacaagaatgaaaagcaattgcaagggcccttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctca

SEQ ID NO: 30431 - DNA, 201 bp, Homo sapiens
cagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtaaaacttgaaggtagacaagctctttgtgtccatacatttgatgg

SEQ ID NO: 30432 - DNA, 201 bp, Homo sapiens
aaaaaaaatgttttctggtcaagtcacatgcctctgaggtttttttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaa

SEQ ID NO: 30433 - DNA, 201 bp, Homo sapiens; identical to SEQ ID NO: 4978

SEQ ID NO: 30434 - DNA, 201 bp, Homo sapiens
accaactccattgttactagatatcctgacactgaagaagctaaaaccaaacaacaatgacaacaacaaacccaagtctgccttatggcacattcttcacrtcgtaacaccttccttgggaccctatttctcagtatggacctgactctcccagggatcctagaatgcaagcatagtgattgcaaaccagaccatttgagg

SEQ ID NO: 30435 - DNA, 201 bp, Homo sapiens
cgcccagagtcgtatcacttgactgcatttgaccattcagttttcagaccaactccattgttactagatatcctgacactgaagaagctaaaaccaaacarcaatgacaacaacaaacccaagtctgccttatggcacattcttcacgtcgtaacaccttccttgggaccctatttctcagtatggacctgactctcccag

SEQ ID NO: 30436 - DNA, 201 bp, Homo sapiens
aggaataataattcagtgaaaggaaatttggatgacatgaactcatttccattagacttgagccacacaaatcaatgggaaaagaaacagctgaatccagsataatatctggctatttggagtgggcatgataatggagggagattggggaggtaacaaaccagctactattaagttcaagtcatgtcagttattcaaatt

SEQ ID NO: 30437 - DNA, 201 bp, Homo sapiens
cagggttattaggaataataattcagtgaaaggaaatttggatgacatgaactcatttccattagacttgagccacacaaatcaatgggaaaagaaacagytgaatccaggataatatctggctatttggagtgggcatgataatggagggagattggggaggtaacaaaccagctactattaagttcaagtcatgtcagt

SEQ ID NO: 30438 - DNA, 201 bp, Homo sapiens
tgaagttgtttagataaatgtgccaggtgctaagctcagggttattaggaataataattcagtgaaaggaaatttggatgacatgaactcatttccattakacttgagccacacaaatcaatgggaaaagaaacagctgaatccaggataatatctggctatttggagtgggcatgataatggagggagattggggaggta

SEQ ID NO: 30439 - DNA, 201 bp, Homo sapiens
ttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaacc

SEQ ID NO: 30440 - DNA, 201 bp, Homo sapiens
caatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgag

SEQ ID NO: 30441 - DNA, 201 bp, Homo sapiens
cactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccaggg

SEQ ID NO: 30442 - DNA, 201 bp, Homo sapiens
ggtaggcttctctctaaataaatggaaatactaactgtccctggctcatagagctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggc

SEQ ID NO: 30443 - DNA, 201 bp, Homo sapiens
taattatctgtatggctttggacgagttgcttttgatctctgatatcaggtaggcttctctctaaataaatggaaatactaactgtccctggctcatagarctctgtgagggttaggcaacaatgcttacaaagctctccatgcagagcctggcaaatcgtaacctctcaataaatgctagtcattgatgtcacttgaata

SEQ ID NO: 30444 - DNA, 201 bp, Homo sapiens
tctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcc

SEQ ID NO: 30445 - DNA, 201 bp, Homo sapiens
gttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaaga

SEQ ID NO: 30446 - DNA, 201 bp, Homo sapiens
tggcatggcctttgtatgacacttccttctagccagactcggatttgggggcatcatatttgggatggctgcaccgcaaacaggaaaggccacaggacagytcacaggttctctctgaacagaagcctgtgagcacgtgcctgtcatttaaaagctgcatggcactcttccccctgcatgcgtttctctcaaggtgtccct

SEQ ID NO: 30447 - DNA, 201 bp, Homo sapiens; identical to SEQ ID NO: 4899

SEQ ID NO: 30448 - DNA, 201 bp, Homo sapiens; identical to SEQ ID NO: 4903

SEQ ID NO: 30449 - DNA, 201 bp, Homo sapiens; identical to SEQ ID NO: 4908

SEQ ID NO: 30450 - DNA, 201 bp, Homo sapiens; identical to SEQ ID NO: 4897

SEQ ID NO: 30451 - DNA, 201 bp, Homo sapiens; identical to SEQ ID NO: 4913

SEQ ID NO: 30452 - DNA, 201 bp, Homo sapiens; identical to SEQ ID NO: 4902

SEQ ID NO: 30453 - DNA, 201 bp, Homo sapiens
tgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctatt

SEQ ID NO: 30454 - DNA, 201 bp, Homo sapiens
ggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagaca

SEQ ID NO: 30455 - DNA, 201 bp, Homo sapiens
gagcctcacactccctggacaaagacatgaaaaactctggatgatttggaagggagatctagaaatggtgaaaggactggcaagtgcctctgtgctgataytgtacctgggctcagtggtctggctaaaggagaggtgctggggccaggtgacaggcgagtctctatacggcaggcccaaaaaatggaggtgcaggcttca

SEQ ID NO: 30456 - DNA, 201 bp, Homo sapiens
aaccctccctaagcagctattgagcctcacactccctggacaaagacatgaaaaactctggatgatttggaagggagatctagaaatggtgaaaggactgscaagtgcctctgtgctgatattgtacctgggctcagtggtctggctaaaggagaggtgctggggccaggtgacaggcgagtctctatacggcaggcccaa

SEQ ID NO: 30457 - DNA, 201 bp, Homo sapiens
cctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactggcaagtgcctctgtgctgatat

SEQ ID NO: 30458 - DNA, 201 bp, Homo sapiens
cattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagaga

SEQ ID NO: 30459 - DNA, 201 bp, Homo sapiens
ccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctat

SEQ ID NO: 30460 - DNA, 201 bp, Homo sapiens
aagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagac

SEQ ID NO: 30461 - DNA, 201 bp, Homo sapiens
ttcttatttggagatgctgttcctctcaagtgggaaaaatttggttatctcaggtggtaaagatgcctttgtttaaaatattcttctgttagtggggacawtaatactactaatttctagtactgacgcttctcatgcaatttaatcagtaggaacctgtttgcatgttcatttgaggaagtaccaaagccaaaagtagct

SEQ ID NO: 30462 - DNA, 201 bp, Homo sapiens
tgcaaatgtgtgaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctgttagtggggacaataatactactaatttctagtactgacgc

SEQ ID NO: 30463 - DNA, 201 bp, Homo sapiens
caagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcaagtgggaaaaat

SEQ ID NO: 30464 - DNA, 201 bp, Homo sapiens
aggagggactcataggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaa

SEQ ID NO: 30465 - DNA, 201 bp, Homo sapiens
aggaggtcaggaagtcattgatgtgggctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcttgggcttgctct

SEQ ID NO: 30466 - DNA, 201 bp, Homo sapiens
ctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcataggacagcctagcatctgaggaaat

SEQ ID NO: 30467 - DNA, 201 bp, Homo sapiens
actttttatttcctttgtggagtccagcccctttgcttattctcagcacaaaagaggcagtagagtgagaagaacgtgaacttcagagcccacccatcccktttcacatttgaatcgcaactctgtcattcaccagctgtgcatccttgggaaagtcacttagcctctctgagctctaatttcctcacagggccgcaggac

SEQ ID NO: 30468 - DNA, 201 bp, Homo sapiens
gcctctcactttttatttcctttgtggagtccagcccctttgcttattctcagcacaaaagaggcagtagagtgagaagaacgtgaacttcagagcccacscatcccttttcacatttgaatcgcaactctgtcattcaccagctgtgcatccttgggaaagtcacttagcctctctgagctctaatttcctcacagggcc

SEQ ID NO: 30469 - DNA, 201 bp, Homo sapiens
tgcttctagctggtcgaaggtcctgtgggagctcacgtttttctcaatcactgatgaccatttgagacataatttggagaaggtttctatcaaatcctagytggactgcagtgaaatgttttcaaactagagaagcaccaaataggccatgataaagaataaataccacctaccccaacctggcaaatgtgtgctcaccca

SEQ ID NO: 30470 - DNA, 201 bp, Homo sapiens
gtatggggtggggaaggggggggggataaagatattaatttggaagcatttgattgctccattattttatcatcttcccatggaaatgttttcataacgcsttgttttttaattattattattattttttgagacagagtctcactgagtcgcccagggcggcggtgtgatctcggctcactgcaacctcagtctcccagg

SEQ ID NO: 30471 - DNA, 201 bp, Homo sapiens
tttgacaatagatgttagctaggagagataagaaatggagcaagggaggggtttcatcccgccgtgttcatttgcttggctgtcctgaaattgcgaatacrcagttgttacctgctcccggtgggaggggggggatatttatttggcatcttgcaattgataggagctgagtgattttagtaggtagtttaactccttaaa

SEQ ID NO: 30472 - DNA, 201 bp, Homo sapiens
tggaagagttgacagagatttgcaggtgaaaaagaaaagaaaaaaaatacagatacgtgtatatatagagaaagacaaaaacttgtctgctagaaacctasggagagagatggtattgcccctgggacattggactttctgtttccagcatggtctgtcgtcttccataatggcatttaattttggaaaaattgcctgagc

SEQ ID NO: 30473 - DNA, 201 bp, Homo sapiens
ttttggattctgtgtggaagagttgacagagatttgcaggtgaaaaagaaaagaaaaaaaatacagatacgtgtatatatagagaaagacaaaaacttgtstgctagaaacctagggagagagatggtattgcccctgggacattggactttctgtttccagcatggtctgtcgtcttccataatggcatttaattttgga

SEQ ID NO: 30474 - DNA, 201 bp, Homo sapiens
gcggcgtgatctctgctgactgcattctccatttcccaggttcaagcgattctcctgcctcagcctcccaagtagctgggactacaggcccctccacaccscacaccgccaccacgcccagctgatttttagtggagacagggtttcaccatgttggccaggctggtcttgaactcctgacctcaagtgatcggcctgcct

SEQ ID NO: 30475 - DNA, 201 bp, Homo sapiens
cagcggcgtgatctctgctgactgcattctccatttcccaggttcaagcgattctcctgcctcagcctcccaagtagctgggactacaggcccctccacascgcacaccgccaccacgcccagctgatttttagtggagacagggtttcaccatgttggccaggctggtcttgaactcctgacctcaagtgatcggcctgc

SEQ ID NO: 30476 - DNA, 201 bp, Homo sapiens
ttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccga

SEQ ID NO: 30477 - DNA, 201 bp, Homo sapiens
ggcacagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcata

SEQ ID NO: 30478 - DNA, 201 bp, Homo sapiens
agcatctggggctgtacacgtctttgtactgcacactgtagggtatccaggattcctggccctgccccatgatataccagcgccatgttgtcatcaaaacraccggaaatgccttttgtgtctccctacttccctttttaacatgtcagcccttggtctcgatattcacatctatatttttccttatcccgttaatatatg

SEQ ID NO: 30479 - DNA, 201 bp, Homo sapiens
tcatgccctgtgtcacctgactcaggcaccattagcatctggggctgtacacgtctttgtactgcacactgtagggtatccaggattcctggccctgcccsatgatataccagcgccatgttgtcatcaaaacgaccggaaatgccttttgtgtctccctacttccctttttaacatgtcagcccttggtctcgatattca

SEQ ID NO: 30480 - DNA, 201 bp, Homo sapiens
ttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttt

SEQ ID NO: 30481 - DNA, 201 bp, Homo sapiens
atgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttg

SEQ ID NO: 30482 - DNA, 201 bp, Homo sapiens
aattcttaaagttctggagcctgggaagtccaagagcaaagcaacggcagattcagcttctgttgagggctcgttccctggctcatagatgatgacttctygctgtgtcaacttagtgggaggggataaagcagctctctggggcttcttttagaaaggcacaaatccactcttgtgatctaatcacctttcaaaggccct

SEQ ID NO: 30483 - DNA, 201 bp, Homo sapiens
cagaaatgtaattcttaaagttctggagcctgggaagtccaagagcaaagcaacggcagattcagcttctgttgagggctcgttccctggctcatagatgrtgacttcttgctgtgtcaacttagtgggaggggataaagcagctctctggggcttcttttagaaaggcacaaatccactcttgtgatctaatcacctttc

SEQ ID NO: 30484 - DNA, 201 bp, Homo sapiens
caaaagtactaaatgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgatgacttcttgctgtgtca

SEQ ID NO: 30485 - DNA, 201 bp, Homo sapiens
cttattcttttacaaaaagggtcagcagactttctgaaaagggacagatagtaaatattttaggctttgtggaccatagggcctgtgtcaaaagtactaawtgttaccattttccttactttgttcaggctgctataacagataccataaactaggtagcttataaataacagaaatgtaattcttaaagttctggagcct

SEQ ID NO: 30486 - DNA, 201 bp, Homo sapiens
tacttattcttttacaaaaagggtcagcagactttctgaaaagggacagatagtaaatattttaggctttgtggaccatagggcctgtgtcaaaagtactmaatgttaccattttccttactttgttcaggctgctataacagataccataaactaggtagcttataaataacagaaatgtaattcttaaagttctggagc

SEQ ID NO: 30487 - DNA, 201 bp, Homo sapiens
acaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttg

SEQ ID NO: 30488 - DNA, 201 bp, Homo sapiens
aagttaaactgatgtctgtgtgtcttcatgtcattaaactttgaatctacggacatgtctttttctttctggcatagtttggaggtcttcattttgtgatwgaatacaaaacaccgagggctttaaggaggcatagtggtatgttcagctgtattttctcataatatagagtcataggaaacctgagccttggcatttgta

SEQ ID NO: 30489 - DNA, 201 bp, Homo sapiens
tgagaaagttaaactgatgtctgtgtgtcttcatgtcattaaactttgaatctacggacatgtctttttctttctggcatagtttggaggtcttcattttrtgattgaatacaaaacaccgagggctttaaggaggcatagtggtatgttcagctgtattttctcataatatagagtcataggaaacctgagccttggcat

SEQ ID NO: 30490 - DNA, 201 bp, Homo sapiens
cccccaaagggggatttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatgg

SEQ ID NO: 30491 - DNA, 201 bp, Homo sapiens
tgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagacacttagtggttc

SEQ ID NO: 30492 - DNA, 201 bp, Homo sapiens
ttccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagccccca

SEQ ID NO: 30493 - DNA, 201 bp, Homo sapiens
cccatgggagctccaactctgtttggtcccaatgtgccctttttgtctcactccttcctcccacacatcctgctccccactcccctaattactcatgattscactaacagccacatcctttcacacctctgagcttttggtcatgctgtaatctctacctgagttccattcctgcctccacccttgcctgtcaaattcctt

SEQ ID NO: 30494 - DNA, 201 bp, Homo sapiens
aaattgctgaagtgcttctcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcg

SEQ ID NO: 30495 - DNA, 201 bp, Homo sapiens
taaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagacagaccttttcacttactg

SEQ ID NO: 30496 - DNA, 201 bp, Homo sapiens
atcccagctctttgggaggctgaggcaggtggatcacctgaggtcaggagtttgagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgag

SEQ ID NO: 30497 - DNA, 201 bp, Homo sapiens
cttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatacaaaaattagccaggcgtggtggcgcatgcctataatcccagctactctgggc

SEQ ID NO: 30498 - DNA, 201 bp, Homo sapiens
ctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttc

SEQ ID NO: 30499 - DNA, 201 bp, Homo sapiens
ttcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagagg

SEQ ID NO: 30500 - DNA, 201 bp, Homo sapiens
gtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagc

SEQ ID NO: 30501 - DNA, 201 bp, Homo sapiens
aaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctat

SEQ ID NO: 30502 - DNA, 201 bp, Homo sapiens
tccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtgg

SEQ ID NO: 30503 - DNA, 201 bp, Homo sapiens
gtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttca

SEQ ID NO: 30504 - DNA, 201 bp, Homo sapiens
aacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatg

SEQ ID NO: 30505 - DNA, 201 bp, Homo sapiens
tccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggttttt

SEQ ID NO: 30506 - DNA, 201 bp, Homo sapiens
gattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaatt

SEQ ID NO: 30507 - DNA, 201 bp, Homo sapiens
ttttcaacgagagttcagaaccacaccatacgggcagtagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggca

SEQ ID NO: 30508 - DNA, 201 bp, Homo sapiens
ttccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactatgtcaggtagacttatttttcgagttgtgctggtta

SEQ ID NO: 30509 - DNA, 201 bp, Homo sapiens
tataactatctgcatttcaggtacagtgatctcctttaaaaaggctgcgtcccagcagcatagaccagctttacctcccagcgtagtcttcagacaagttrgggtattgccgaagtccattcttgactttttttaatagtgcaaacaaatcatcttgtttttaggaaaacatgaaattataaagaaattgacttcaatcac

SEQ ID NO: 30510 - DNA, 201 bp, Homo sapiens
aatctttcggtctaagcaaattaatgtcatttttataactatctgcatttcaggtacagtgatctcctttaaaaaggctgcgtcccagcagcatagaccarctttacctcccagcgtagtcttcagacaagttggggtattgccgaagtccattcttgactttttttaatagtgcaaacaaatcatcttgtttttaggaaa

SEQ ID NO: 30511 - DNA, 201 bp, Homo sapiens
aatcaactcaattaccagccctctcagacattttcataatgttttctggtagttgctctcctgtgaaaatctttcggtctaagcaaattaatgtcattttyataactatctgcatttcaggtacagtgatctcctttaaaaaggctgcgtcccagcagcatagaccagctttacctcccagcgtagtcttcagacaagttg

SEQ ID NO: 30512 - DNA, 201 bp, Homo sapiens
accaaggtcatactaatcaactcaattaccagccctctcagacattttcataatgttttctggtagttgctctcctgtgaaaatctttcggtctaagcaarttaatgtcatttttataactatctgcatttcaggtacagtgatctcctttaaaaaggctgcgtcccagcagcatagaccagctttacctcccagcgtagt

SEQ ID NO: 30513 - DNA, 201 bp, Homo sapiens
gttcagaggcagtgaaagcgtgcttctcaggactcattgtccagaagattctgcctacagctggttttacgcagagaagtagcacacaaacccagtccatsatttcttatttgactctgtcctgtttactctgtcagggtgaaaagcacaggccaagctcggctagtcaaagcattactttgtcacaggcaggcttggctt

SEQ ID NO: 30514 - DNA, 201 bp, Homo sapiens
gtattctgttccctctttgctagttcagaggcagtgaaagcgtgcttctcaggactcattgtccagaagattctgcctacagctggttttacgcagagaastagcacacaaacccagtccatgatttcttatttgactctgtcctgtttactctgtcagggtgaaaagcacaggccaagctcggctagtcaaagcattact

SEQ ID NO: 30515 - DNA, 201 bp, Homo sapiens
ttcccactgcagccggtagcatattgcttcataaatgtctataaaaaaatacgaaaaatagaatcagagcaaattcagcatagacctccttgggatgtttwttctttgtttatgttggtgttttgttttgtgttgtttcagctggggtgcagttgtattctgttccctctttgctagttcagaggcagtgaaagcgtgctt

SEQ ID NO: 30516 - DNA, 201 bp, Homo sapiens
agccagacatggaatcctttcttatgattaatgcagctaaatttcccactgcagccggtagcatattgcttcataaatgtctataaaaaaatacgaaaaayagaatcagagcaaattcagcatagacctccttgggatgtttattctttgtttatgttggtgttttgttttgtgttgtttcagctggggtgcagttgtatt

SEQ ID NO: 30517 - DNA, 201 bp, Homo sapiens
aaacttgatatggaaggtcttcacagattaaaacgaaggaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtat

SEQ ID NO: 30518 - DNA, 201 bp, Homo sapiens
agggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacaccct

SEQ ID NO: 30519 - DNA, 201 bp, Homo sapiens
agagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgctt

SEQ ID NO: 30520 - DNA, 201 bp, Homo sapiens
atcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttca

SEQ ID NO: 30521 - DNA, 201 bp, Homo sapiens
tggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcaatccacccgcctt

SEQ ID NO: 30522 - DNA, 201 bp, Homo sapiens
attctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtc

SEQ ID NO: 30523 - DNA, 201 bp, Homo sapiens
gaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgatt

SEQ ID NO: 30524 - DNA, 201 bp, Homo sapiens
ctcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaagg

SEQ ID NO: 30525 - DNA, 201 bp, Homo sapiens
gccagagtttttttttcccttgtcttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactc

SEQ ID NO: 30526 - DNA, 201 bp, Homo sapiens
ctcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttt

SEQ ID NO: 30527 - DNA, 201 bp, Homo sapiens
ctctcaaagatagacatggacatataaataattttttaaaatcctcttttgcaaaaaaaaaaaaaaaaagaggtgaatttagttgaaaggatatagccacwcttttctgaagtgatggggatattcgatggcaattttgtgttttcttcacttggaaaaactaaaaagtttgcaacatttaaaaaaaatacaacccttatg

SEQ ID NO: 30528 - DNA, 201 bp, Homo sapiens
cctctcaaagatagacatggacatataaataattttttaaaatcctcttttgcaaaaaaaaaaaaaaaaagaggtgaatttagttgaaaggatatagccaytcttttctgaagtgatggggatattcgatggcaattttgtgttttcttcacttggaaaaactaaaaagtttgcaacatttaaaaaaaatacaacccttat

SEQ ID NO: 30529 - DNA, 201 bp, Homo sapiens
aatgtcagagccctaaatggtatgaaaaataggcaacttgggtcatgccactacagatcgacacccactaaatccttttaatttagtctagtgcaacaagkatttgtgtaagtgtcctctgccctggacaccggtgaggtcaccgtgggaatggctgggcaggaacaaagccttttgtttccagctgagtttccttttctg

SEQ ID NO: 30530 - DNA, 201 bp, Homo sapiens
taccaagtcatttggtttacatcgggaatgccttttgtcgttatgtctagacccctggagaacagcccacggcaatgcacttgtggaaattcggactgtgrattacactgagtaacaatcctaataatacctgcacacaatcagttgcctgtccaaaaagcaataaagaacctctagattttgtggtcaccatattaatca

SEQ ID NO: 30531 - DNA, 201 bp, Homo sapiens
cactggtgtgtggggtcataccaagtcatttggtttacatcgggaatgccttttgtcgttatgtctagacccctggagaacagcccacggcaatgcacttstggaaattcggactgtggattacactgagtaacaatcctaataatacctgcacacaatcagttgcctgtccaaaaagcaataaagaacctctagattttg

SEQ ID NO: 30532 - DNA, 201 bp, Homo sapiens
gacggtggaaagagaggactgctcctagcgtgagagtgtcagggaagcttgctgggggaaatacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttg

SEQ ID NO: 30533 - DNA, 201 bp, Homo sapiens
agggaagagcagggatagaagtgggctccgggtctaggagacggtggaaagagaggactgctcctagcgtgagagtgtcagggaagcttgctgggggaaayacaaggaaggaagagaatgcaggcagctcaaaagagccgggcaaggagacctgcagagcgagcggaggcctggtttctgtgaagcacagggcaggaaaat

SEQ ID NO: 30534 - DNA, 201 bp, Homo sapiens
ccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgc

SEQ ID NO: 30535 - DNA, 201 bp, Homo sapiens
atttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaac

SEQ ID NO: 30536 - DNA, 201 bp, Homo sapiens
aacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagcccca

SEQ ID NO: 30537 - DNA, 201 bp, Homo sapiens
agagggagaggacagtaaccaataccgctccttctacatgatcagtgttcaggttgaagacaaacagggctccaattatgttgtgatttagaaggcgacaragctgagacctcaccctctgcttatgggctgcatgcctttctcagtgaaataacgcagaatgcagaggccatgcctgcagatcaggggtgctagaggata

SEQ ID NO: 30538 - DNA, 201 bp, Homo sapiens
gtggcagagggagaggacagtaaccaataccgctccttctacatgatcagtgttcaggttgaagacaaacagggctccaattatgttgtgatttagaaggygacagagctgagacctcaccctctgcttatgggctgcatgcctttctcagtgaaataacgcagaatgcagaggccatgcctgcagatcaggggtgctaga

SEQ ID NO: 30539 - DNA, 201 bp, Homo sapiens
agagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggcgacagagctgagacctcaccctctgctta

SEQ ID NO: 30540 - DNA, 201 bp, Homo sapiens
ttgaggttctttccaagtaaaggcgttattctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtgg

SEQ ID NO: 30541 - DNA, 201 bp, Homo sapiens
aaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatccgtaggctcttatttcctagacatgaagag

SEQ ID NO: 30542 - DNA, 201 bp, Homo sapiens
ggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatg

SEQ ID NO: 30543 - DNA, 201 bp, Homo sapiens
ctatatgatcatatgattttcctttagctttttgatatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagttta

SEQ ID NO: 30544 - DNA, 201 bp, Homo sapiens
tactaagaaacttttgaaaatgataatgggtgtgtactttttatcaactgctttttgtatgccaatctatatgatcatatgattttcctttagctttttgrtatggtggactatattgattttaaatattgaaccagccttgaagacctggaataaatcccacttggtcatggcatatatgtttttttatacattgttgga

SEQ ID NO: 30545 - DNA, 201 bp, Homo sapiens
gattcttctcaattcctaaattactaagaaacttttgaaaatgataatgggtgtgtactttttatcaactgctttttgtatgccaatctatatgatcatawgattttcctttagctttttgatatggtggactatattgattttaaatattgaaccagccttgaagacctggaataaatcccacttggtcatggcatatat

SEQ ID NO: 30546 - DNA, 201 bp, Homo sapiens
tttatttttgtttgtatttgttagtttttttgagatttcttgggattttctatctagcctgtcatgtcatatgcaaatagagaattttatttcttcctttrtaatatgtgtgccctttttttattgccttattgtagtggctagaacttcctgtgctatgttgaacaagagtagtgagaacatccttgccttgctcctgat

SEQ ID NO: 30547 - DNA, 201 bp, Homo sapiens
gttttttatttttgtttgtatttgttagtttttttgagatttcttgggattttctatctagcctgtcatgtcatatgcaaatagagaattttatttcttcytttataatatgtgtgccctttttttattgccttattgtagtggctagaacttcctgtgctatgttgaacaagagtagtgagaacatccttgccttgctcc

SEQ ID NO: 30548 - DNA, 201 bp, Homo sapiens
ttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtc

SEQ ID NO: 30549 - DNA, 201 bp, Homo sapiens
tgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatag

SEQ ID NO: 30550 - DNA, 201 bp, Homo sapiens
tacaaaaactgttaccgcctaacacattaaatgtatttaaattatttgttctattaaaatgtcagtgtatttcttgaattttaactgtgcctgaagatcartcattgtaacagctgcagggaaggctttatgacttacctgaacggtggtgtattctgtggctcggctaagtggattcttcgactttaatagattttacta

SEQ ID NO: 30551 - DNA, 201 bp, Homo sapiens
tttgggaagttcccaaatctgtcagtatatattacaaaaactgttaccgcctaacacattaaatgtatttaaattatttgttctattaaaatgtcagtgtmtttcttgaattttaactgtgcctgaagatcaatcattgtaacagctgcagggaaggctttatgacttacctgaacggtggtgtattctgtggctcggcta

SEQ ID NO: 30552 - DNA, 201 bp, Homo sapiens
catctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgtttttgttttgtttctttttgagatagggtc

SEQ ID NO: 30553 - DNA, 201 bp, Homo sapiens
aacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgt

SEQ ID NO: 30554 - DNA, 201 bp, Homo sapiens
cgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggag

SEQ ID NO: 30555 - DNA, 201 bp, Homo sapiens
ttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaac

SEQ ID NO: 30556 - DNA, 201 bp, Homo sapiens
ccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactca

SEQ ID NO: 30557 - DNA, 201 bp, Homo sapiens
ggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggt

SEQ ID NO: 30558 - DNA, 201 bp, Homo sapiens
ggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggct

SEQ ID NO: 30559 - DNA, 201 bp, Homo sapiens
tgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtag

SEQ ID NO: 30560 - DNA, 201 bp, Homo sapiens
aagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtgga

SEQ ID NO: 30561 - DNA, 201 bp, Homo sapiens
gtcttaacttttcaaaaacaggacatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtctt

SEQ ID NO: 30562 - DNA, 201 bp, Homo sapiens
gttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccctagcctgggaagaaaaatcggt

SEQ ID NO: 30563 - DNA, 201 bp, Homo sapiens
ctgcgggtgtgtgagccaagggggccctgtgacccttgaaatagaaaagggggaaatggctgcatgccaaccgaagagaccactgcattgttggccataartgaaactagtgagatgtgtgggatatcataaaaagaacattgacataatccttttttggatgaagttatatcacaaccagaacacacaatgaccagcagg

SEQ ID NO: 30564 - DNA, 201 bp, Homo sapiens
atttccatgttctccgcacagtgcggagctactgcgggtgtgtgagccaagggggccctgtgacccttgaaatagaaaagggggaaatggctgcatgccarccgaagagaccactgcattgttggccataagtgaaactagtgagatgtgtgggatatcataaaaagaacattgacataatccttttttggatgaagttat

SEQ ID NO: 30565 - DNA, 201 bp, Homo sapiens
agatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccaaccgaagagaccactgcattgttggccataagtgaa

SEQ ID NO: 30566 - DNA, 201 bp, Homo sapiens
gccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagt

SEQ ID NO: 30567 - DNA, 201 bp, Homo sapiens
aatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacgtaaaa

SEQ ID NO: 30568 - DNA, 201 bp, Homo sapiens
ctcctgtatctcagtaggcactgttcaagcatttgaacttcatcaagtatcaagacaagtctaagagaaggtggggagagaccatcagggcctaggattgsaaaacctccaacgcaaaatagagatgtagttttagcgtgctgcccaatattaaaagattgtataaatgaggggggcacacttcctgatatgttcgttatg

SEQ ID NO: 30569 - DNA, 201 bp, Homo sapiens
taaaatgttgcctcctgtatctcagtaggcactgttcaagcatttgaacttcatcaagtatcaagacaagtctaagagaaggtggggagagaccatcaggrcctaggattggaaaacctccaacgcaaaatagagatgtagttttagcgtgctgcccaatattaaaagattgtataaatgaggggggcacacttcctgata

SEQ ID NO: 30570 - DNA, 201 bp, Homo sapiens
aggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagat

SEQ ID NO: 30571 - DNA, 201 bp, Homo sapiens
gctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatgga

SEQ ID NO: 30572 - DNA, 201 bp, Homo sapiens
ccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaac

SEQ ID NO: 30573 - DNA, 201 bp, Homo sapiens
ttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagaga

SEQ ID NO: 30574 - DNA, 201 bp, Homo sapiens
tctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattg

SEQ ID NO: 30575 - DNA, 201 bp, Homo sapiens
gcatcttacctataaaaataatgcagatacattcgtaactccccaggttttcgggagtggaaatgagggcagctggggagtgaatctgtcgtttgttgagrctctttttcctgcttgccagacactgatctaggctcattcatacaccagttcattcatcctcataacagttctgtgcctgagtagattcttgtccttatg

SEQ ID NO: 30576 - DNA, 201 bp, Homo sapiens
ggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaag

SEQ ID NO: 30577 - DNA, 201 bp, Homo sapiens
gggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctac

SEQ ID NO: 30578 - DNA, 201 bp, Homo sapiens
aaccacacagcccagtggccgtggcctgggcagggaaaccgcaactgcctgcaggaagagtgcagtttatttagataacattttcacttaacatcctgccrttaatgacctccacctggcaacctttatttaatccaaaactcagggactggattttccatacggcctgtgaggccagggggctcagttgttcctcataga

SEQ ID NO: 30579 - DNA, 201 bp, Homo sapiens
acaacataaccacacagcccagtggccgtggcctgggcagggaaaccgcaactgcctgcaggaagagtgcagtttatttagataacattttcacttaacaycctgccgttaatgacctccacctggcaacctttatttaatccaaaactcagggactggattttccatacggcctgtgaggccagggggctcagttgttcc

SEQ ID NO: 30580 - DNA, 201 bp, Homo sapiens
ggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgct

SEQ ID NO: 30581 - DNA, 201 bp, Homo sapiens
tgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccaca

SEQ ID NO: 30582 - DNA, 201 bp, Homo sapiens
accacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaa

SEQ ID NO: 30583 - DNA, 201 bp, Homo sapiens
tttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttg

SEQ ID NO: 30584 - DNA, 201 bp, Homo sapiens
ggaaaatgtgatatgacagactggaaccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaattt

SEQ ID NO: 30585 - DNA, 201 bp, Homo sapiens
caatttcctcatgatactggaaggcagtctccggtcagcacggggctgggtctagagttttcagtttacaaaagtggaaaatgtgatatgacagactggawccagcacagggacgcagcccctcacctgctgggggtctttgggtgggtcctgtagccccagagcctctcgatgagctatgaacaggaacagaaccagcac

SEQ ID NO: 30586 - DNA, 201 bp, Homo sapiens
ggggtcagggggagggtgcacctgtccgccaccccaatttcctcatgatactggaaggcagtctccggtcagcacggggctgggtctagagttttcagttyacaaaagtggaaaatgtgatatgacagactggaaccagcacagggacgcagcccctcacctgctgggggtctttgggtgggtcctgtagccccagagcct

SEQ ID NO: 30587 - DNA, 201 bp, Homo sapiens
acctacagaaaaaaatgccaagaatgcacgctgggaattcattaagagatttcaggacgttgaaatactgtgcgtacttgcaatccccacttgaccaaagstgtccaaacctcgacagacagcggccagagaaggccccatcatagactctgcgcctggctaattactcaggagcaaagcaggtcgttaggggtcaggggg

SEQ ID NO: 30588 - DNA, 201 bp, Homo sapiens
ttggagacctacagaaaaaaatgccaagaatgcacgctgggaattcattaagagatttcaggacgttgaaatactgtgcgtacttgcaatccccacttgascaaaggtgtccaaacctcgacagacagcggccagagaaggccccatcatagactctgcgcctggctaattactcaggagcaaagcaggtcgttaggggtc

SEQ ID NO: 30589 - DNA, 201 bp, Homo sapiens
tgagtccttttcagagagtcatttggagacctacagaaaaaaatgccaagaatgcacgctgggaattcattaagagatttcaggacgttgaaatactgtgygtacttgcaatccccacttgaccaaaggtgtccaaacctcgacagacagcggccagagaaggccccatcatagactctgcgcctggctaattactcagga

SEQ ID NO: 30590 - DNA, 201 bp, Homo sapiens
atcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgata

SEQ ID NO: 30591 - DNA, 201 bp, Homo sapiens
ctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcata

SEQ ID NO: 30592 - DNA, 201 bp, Homo sapiens
ctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctcca

SEQ ID NO: 30593 - DNA, 201 bp, Homo sapiens
aagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctacc

SEQ ID NO: 30594 - DNA, 201 bp, Homo sapiens
agttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccag

SEQ ID NO: 30595 - DNA, 201 bp, Homo sapiens
aaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaa

SEQ ID NO: 30596 - DNA, 201 bp, Homo sapiens
acagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccatagg

SEQ ID NO: 30597 - DNA, 201 bp, Homo sapiens
tcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaac

SEQ ID NO: 30598 - DNA, 201 bp, Homo sapiens
ttggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcattctacttggggaaagagacgtgaaagaaatcaagacatgcaagcaagg

SEQ ID NO: 30599 - DNA, 201 bp, Homo sapiens
gtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgt

SEQ ID NO: 30600 - DNA, 201 bp, Homo sapiens
agccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctg

SEQ ID NO: 30601 - DNA, 201 bp, Homo sapiens
cttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaa

SEQ ID NO: 30602 - DNA, 201 bp, Homo sapiens
gcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcaaaccaaagagcacaccg

SEQ ID NO: 30603 - DNA, 201 bp, Homo sapiens
tatgactatttcatgagtgcttactatataccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgctt

SEQ ID NO: 30604 - DNA, 201 bp, Homo sapiens
gtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtccatccatccatccatcctgcctccctcc

SEQ ID NO: 30605 - DNA, 201 bp, Homo sapiens
cccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactc

SEQ ID NO: 30606 - DNA, 201 bp, Homo sapiens
gggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacatta

SEQ ID NO: 30607 - DNA, 201 bp, Homo sapiens
ctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtat

SEQ ID NO: 30608 - DNA, 201 bp, Homo sapiens
ctttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtct

SEQ ID NO: 30609 - DNA, 201 bp, Homo sapiens
cctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctcc

SEQ ID NO: 30610 - DNA, 201 bp, Homo sapiens
tacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatg

SEQ ID NO: 30611 - DNA, 201 bp, Homo sapiens
tagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatc

SEQ ID NO: 30612 - DNA, 201 bp, Homo sapiens
catgtagattgtacatcgtttgtcgataaatcagtgtacaaatactaggggtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccac

SEQ ID NO: 30613 - DNA, 201 bp, Homo sapiens
ttatctcaacccatttaaatgtcttttccttgcaatgttttgtaatattacatgtagattgtacatcgtttgtcgataaatcagtgtacaaatactagggrtgagtgtgctcaaaacttatttttactgataatagtccatgatcaaggcagtttggagaccactcaggacagggaaaacgcagactcatgtgacccatca

SEQ ID NO: 30614 - DNA, 201 bp, Homo sapiens
ttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactaggggtgagtgtgctcaaaacttattttt

SEQ ID NO: 30615 - DNA, 201 bp, Homo sapiens
tgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacata

SEQ ID NO: 30616 - DNA, 201 bp, Homo sapiens
aatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaa

SEQ ID NO: 30617 - DNA, 201 bp, Homo sapiens
ggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagat

SEQ ID NO: 30618 - DNA, 201 bp, Homo sapiens
tgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatc

SEQ ID NO: 30619 - DNA, 201 bp, Homo sapiens
ctgtagttcatgaaacattcccttcgattctttgaactctctcatacctttcccttaaattcttctttttcccttatgtcaagcttctttcagtaacaacwgaaaggctaatagtagtgctgtgtggggaggactttggacttggggattggactccatgggagaggtcagctccttgtctccctggtggtgagacaggga

SEQ ID NO: 30620 - DNA, 201 bp, Homo sapiens
tccagtccgtgggggccctggtgctactgctgtagttcatgaaacattcccttcgattctttgaactctctcatacctttcccttaaattcttctttttcscttatgtcaagcttctttcagtaacaactgaaaggctaatagtagtgctgtgtggggaggactttggacttggggattggactccatgggagaggtcagc

SEQ ID NO: 30621 - DNA, 201 bp, Homo sapiens
tagggaggctgaggcaggagaatcacttcaacccggaaggcggaggtttcagtgagctgagatccagcctgggtgacagagcaagactccatctcaaagcraaacaaaacaaatgagggtcctcatcagcgtgcctttgacactgtcctctggtcctggtgatctgaatacatcaccacagaactgccagggtacgtgttt

SEQ ID NO: 30622 - DNA, 201 bp, Homo sapiens
gtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaa

SEQ ID NO: 30623 - DNA, 201 bp, Homo sapiens
gtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtca

SEQ ID NO: 30624 - DNA, 201 bp, Homo sapiens
acacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccata

SEQ ID NO: 30625 - DNA, 201 bp, Homo sapiens
accatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcga

SEQ ID NO: 30626 - DNA, 201 bp, Homo sapiens
gaataaaggcatggatgtgactgaggaggtaaaggtgaagaattggggaggggtggatggggctgactcatgacctaaagaacatggcatctggggctctyttgaaataatctgcactaaccactcattcacatttttttgagtctgtaagatcccaggcactcttggtagcaggggggttaggtgggtgaagggacaagt

SEQ ID NO: 30627 - DNA, 201 bp, Homo sapiens
agacatgaataaaggcatggatgtgactgaggaggtaaaggtgaagaattggggaggggtggatggggctgactcatgacctaaagaacatggcatctggrgctctcttgaaataatctgcactaaccactcattcacatttttttgagtctgtaagatcccaggcactcttggtagcaggggggttaggtgggtgaaggg

SEQ ID NO: 30628 - DNA, 201 bp, Homo sapiens
gttccaatgtttctgaaggatgtttttttaaaagaagtattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaaca

SEQ ID NO: 30629 - DNA, 201 bp, Homo sapiens
tgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggttcctttggaggagacatgaataaaggcatggatgtga

SEQ ID NO: 30630 - DNA, 201 bp, Homo sapiens
ttgcaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaagg

SEQ ID NO: 30631 - DNA, 201 bp, Homo sapiens
ttaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgctatg

SEQ ID NO: 30632 - DNA, 201 bp, Homo sapiens
gcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacct

SEQ ID NO: 30633 - DNA, 201 bp, Homo sapiens
attcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccag

SEQ ID NO: 30634 - DNA, 201 bp, Homo sapiens
ctctttctcgatccttgcagtttcccttttgacctgtgggtacacatggtactgacgcaattggcacctcagatggttcttcctgacagctacccttgcamctgactcaggatacaaactacctttttttttggagacagatctcactttatcacccagtctggagtgtaattgacgcaatcctggctggctgcagccttg

SEQ ID NO: 30635 - DNA, 201 bp, Homo sapiens
acattgaaaacttatccaggagaggaaaggctctttcagctgctctttctcgatccttgcagtttcccttttgacctgtgggtacacatggtactgacgcrattggcacctcagatggttcttcctgacagctacccttgcaactgactcaggatacaaactacctttttttttggagacagatctcactttatcacccag

SEQ ID NO: 30636 - DNA, 201 bp, Homo sapiens
gctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcaattggcacctcagatggttcttcctg

SEQ ID NO: 30637 - DNA, 201 bp, Homo sapiens
gcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgc

SEQ ID NO: 30638 - DNA, 201 bp, Homo sapiens
ttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccac

SEQ ID NO: 30639 - DNA, 201 bp, Homo sapiens
ggtggttcacacctgtaatctccacactttgggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtt

SEQ ID NO: 30640 - DNA, 201 bp, Homo sapiens
gacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaacgtgagatcctgtctctacaaaaaataaaa

SEQ ID NO: 30641 - DNA, 201 bp, Homo sapiens
ctaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagcta

SEQ ID NO: 30642 - DNA, 201 bp, Homo sapiens
cagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccatt

SEQ ID NO: 30643 - DNA, 201 bp, Homo sapiens
tctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaa

SEQ ID NO: 30644 - DNA, 201 bp, Homo sapiens
atcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacat

SEQ ID NO: 30645 - DNA, 201 bp, Homo sapiens
gtgaatgggtttggagccaacagggataatagacaacgctatcaagaggggggccaaccacacatgtgcagccactgtatgacgtctggattttccttgasttatggtgatcactattgggaggtggtaagcaaacaggtgacataatttgaatcatggttttaaaagacgccatggttgccatgaggaggacaatgcgta

SEQ ID NO: 30646 - DNA, 201 bp, Homo sapiens
acctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatc

SEQ ID NO: 30647 - DNA, 201 bp, Homo sapiens
ccaccatacccagccaaaatattcttttcaaagtgattagaagtaggagaagcttgctctctttttattggcacttctgtcttacatgcactttttgattkaaattattctgtcttctatgaaatgacagtgattggaggtggtttatttttttttaagtctgcttactcggaaaaataaaacaaagttgacaacctgatt

SEQ ID NO: 30648 - DNA, 201 bp, Homo sapiens
actcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgattgaaattattctgtcttctatgaaatgacagtgattgga

SEQ ID NO: 30649 - DNA, 201 bp, Homo sapiens
ttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttat

SEQ ID NO: 30650 - DNA, 201 bp, Homo sapiens
agaataaaatatcatcaggagcagctcatgtgaccagaatgtgacaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcaca

SEQ ID NO: 30651 - DNA, 201 bp, Homo sapiens
gggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggacttcaaagtccaggttgcaccatccactttatagatgaggaaagta

SEQ ID NO: 30652 - DNA, 201 bp, Homo sapiens
tctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtga

SEQ ID NO: 30653 - DNA, 201 bp, Homo sapiens
gagaatcacttgaacccgagaggcaggggttacagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttcc

SEQ ID NO: 30654 - DNA, 201 bp, Homo sapiens
aaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtcatgtcactgcacctccagcctgggcaacaga

SEQ ID NO: 30655 - DNA, 201 bp, Homo sapiens
cagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattgg

SEQ ID NO: 30656 - DNA, 201 bp, Homo sapiens
atagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagct

SEQ ID NO: 30657 - DNA, 201 bp, Homo sapiens
ggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcc

SEQ ID NO: 30658 - DNA, 201 bp, Homo sapiens
agctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaa

SEQ ID NO: 30659 - DNA, 201 bp, Homo sapiens
taaatagatgcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggcca

SEQ ID NO: 30660 - DNA, 201 bp, Homo sapiens
ctgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcaatgcatcat

SEQ ID NO: 30661 - DNA, 201 bp, Homo sapiens
ctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctg

SEQ ID NO: 30662 - DNA, 201 bp, Homo sapiens
tttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgc

SEQ ID NO: 30663 - DNA, 201 bp, Homo sapiens
tccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatt

SEQ ID NO: 30664 - DNA, 201 bp, Homo sapiens
actgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatc

SEQ ID NO: 30665 - DNA, 201 bp, Homo sapiens
cttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaaggg

SEQ ID NO: 30666 - DNA, 201 bp, Homo sapiens
gactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttat

SEQ ID NO: 30667 - DNA, 201 bp, Homo sapiens
tcctttcttcttcagtgccacctgccttattttactcacccagaaggaagccgggtccctctttgcccctttgggtgtttgtgaaaagcaagttgtaaacwctgaattctataaactgttggagacagattctggagagacactcaggcttagctctagaaagaaacgggtaagacagaggaggttcagggcaactgtgtt

SEQ ID NO: 30668 - DNA, 201 bp, Homo sapiens
aagattcctttcttcttcagtgccacctgccttattttactcacccagaaggaagccgggtccctctttgcccctttgggtgtttgtgaaaagcaagttgyaaacactgaattctataaactgttggagacagattctggagagacactcaggcttagctctagaaagaaacgggtaagacagaggaggttcagggcaact

SEQ ID NO: 30669 - DNA, 201 bp, Homo sapiens
ttaaaagtcctggttcaggctgggacttctgctcagggtctcatgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcagg

SEQ ID NO: 30670 - DNA, 201 bp, Homo sapiens
acctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacg

SEQ ID NO: 30671 - DNA, 201 bp, Homo sapiens
gagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcaga

SEQ ID NO: 30672 - DNA, 201 bp, Homo sapiens
gctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggctcaagctattcac

SEQ ID NO: 30673 - DNA, 201 bp, Homo sapiens
ctgggactactgtgatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaact

SEQ ID NO: 30674 - DNA, 201 bp, Homo sapiens
agtgatttgcccaccttagcctcctaaagtactgggattacagacaagagccactgcgcagacggacatatgaatttttaatttgatatcattgtgatcartttgaagatccacatatggctgagggctactctaatgagtggtgcagctccaaggcagagagatggctgtgattaaccaatgaatgagggaacaaatatc

SEQ ID NO: 30675 - DNA, 201 bp, Homo sapiens
cccaccttagcctcctaaagtactgggattacagacaagagccactgcgcagacggacatatgaatttttaatttgatatcattgtgatcaatttgaagakccacatatggctgagggctactctaatgagtggtgcagctccaaggcagagagatggctgtgattaaccaatgaatgagggaacaaatatccaggcagaa

SEQ ID NO: 30676 - DNA, 201 bp, Homo sapiens
ggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggt

SEQ ID NO: 30677 - DNA, 201 bp, Homo sapiens
ctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgactgggtcccgggtctcctcggaggtcggtttgcatcacgtggat

SEQ ID NO: 30678 - DNA, 201 bp, Homo sapiens
ctgggtcccgggtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcct

SEQ ID NO: 30679 - DNA, 201 bp, Homo sapiens
gtatggtcttaggccctggaataagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaa

SEQ ID NO: 30680 - DNA, 201 bp, Homo sapiens
agctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttaagagttaacctgagtgtctgctgcatagtaggtgctcaa

SEQ ID NO: 30681 - DNA, 201 bp, Homo sapiens
cgtgtgaccttccacatgctttttgatttttcttgaactcacttttcctttgtttgcaaaatagtaacaatattttccttccaagtgatggtgaggatttmagagttaacctgagtgtctgctgcatagtaggtgctcaataaactataacgtctttatttcttttccttccaatgagaagtcacttcctggagggaagcc

SEQ ID NO: 30682 - DNA, 201 bp, Homo sapiens
gtttgcaaaatagtaacaatattttccttccaagtgatggtgaggatttaagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggt

SEQ ID NO: 30683 - DNA, 201 bp, Homo sapiens
tactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctag

SEQ ID NO: 30684 - DNA, 201 bp, Homo sapiens
acttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacaactacta

SEQ ID NO: 30685 - DNA, 201 bp, Homo sapiens
tcatcattaacatgccttatctgacatgtggcaataacttctgcctttcttatgtcatctgcatggttgcagtggatagtcactggacaattgatgaacamctactacatgctagatctctccctggggagagtgcttgtctttgaaacagtcaaaggaggaaggaagaaaagagaggcagaacaattataataaagcaac

SEQ ID NO: 30686 - DNA, 201 bp, Homo sapiens
ccttatctgacatgtggcaataacttctgcctttcttatgtcatctgcatggttgcagtggatagtcactggacaattgatgaacaactactacatgctaratctctccctggggagagtgcttgtctttgaaacagtcaaaggaggaaggaagaaaagagaggcagaacaattataataaagcaacttaacccattgaga

SEQ ID NO: 30687 - DNA, 201 bp, Homo sapiens
aaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaaga

SEQ ID NO: 30688 - DNA, 201 bp, Homo sapiens
gtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaa

SEQ ID NO: 30689 - DNA, 201 bp, Homo sapiens
tgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcataggg

SEQ ID NO: 30690 - DNA, 201 bp, Homo sapiens
ctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaacaaaaataatacctacaataaccacaatatagcaacagcaatcatgttca

SEQ ID NO: 30691 - DNA, 201 bp, Homo sapiens
gtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtat

SEQ ID NO: 30692 - DNA, 201 bp, Homo sapiens
atttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggag

SEQ ID NO: 30693 - DNA, 201 bp, Homo sapiens
cttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccatttt

SEQ ID NO: 30694 - DNA, 201 bp, Homo sapiens
aattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccgttctggagagcctttgattataacatca

SEQ ID NO: 30695 - DNA, 201 bp, Homo sapiens
tgaaaaatctcttcctttcctatcgtgaattcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcggga

SEQ ID NO: 30696 - DNA, 201 bp, Homo sapiens
ttctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccacgcccgactgctttattt

SEQ ID NO: 30697 - DNA, 201 bp, Homo sapiens
tcaccgtgttacccaggatggtctcgatctcctgacctcatgatccacctgccttggcctcccaaagtgctgggattacaggcgtgagccaccacgcccgrctgctttattttcctttgtgttcctaatacctggcccagtgtctggcaaatggaaagttcccctggatgtagttgggtgacactatgagtgtatcgttag

SEQ ID NO: 30698 - DNA, 201 bp, Homo sapiens
ttttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatctgtgcaccagtaaagggttctgatgtgtgataaatttat

SEQ ID NO: 30699 - DNA, 201 bp, Homo sapiens
catcagccattaagaaaaaggtatgcagtctacatgcctcttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggactttgga

SEQ ID NO: 30700 - DNA, 201 bp, Homo sapiens
tagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatg

SEQ ID NO: 30701 - DNA, 201 bp, Homo sapiens
accaccattctcccctactttgtctatgaattcgactactcttggtacctcatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttgg

SEQ ID NO: 30702 - DNA, 201 bp, Homo sapiens
gactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctg

SEQ ID NO: 30703 - DNA, 201 bp, Homo sapiens
gacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgcccc

SEQ ID NO: 30704 - DNA, 201 bp, Homo sapiens
acgaaacataccttccagtctcccgagtagtgtattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaa

SEQ ID NO: 30705 - DNA, 201 bp, Homo sapiens
gctgggagtacaagtgtgcaccaccatgcctggctaatgtttgtatttttagtagggacggggtttcgccatgttggccaggctggtgtcaaactcctgayctcaggtgttccaagaacaaaaggccaaccccattagacggtggccaagttggtgctgtgaacagggatcctgcctctgcctcccaaagtgatgggatta

SEQ ID NO: 30706 - DNA, 201 bp, Homo sapiens
agcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcac

SEQ ID NO: 30707 - DNA, 201 bp, Homo sapiens
tgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatca

SEQ ID NO: 30708 - DNA, 201 bp, Homo sapiens
gagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctc

SEQ ID NO: 30709 - DNA, 201 bp, Homo sapiens
acatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcagctcaca

SEQ ID NO: 30710 - DNA, 201 bp, Homo sapiens
ttggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattg

SEQ ID NO: 30711 - DNA, 201 bp, Homo sapiens
gagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggattaaaaaaatggtttttgatttatgaaaaatttttctgc

SEQ ID NO: 30712 - DNA, 201 bp, Homo sapiens
agtcttcaggcccacagtgtaggcattcaacaaacgctcttcagggagaaggaaagttaccatcaaaatccgtcgttgaaagtattgaagttccagctggyggtctgatacagcttagatgttgtccctgcccaaagctcatgtcaaaaggtaatctgcagcgttggaggtggggcatggtgggaggtgattgggtcatgg

SEQ ID NO: 30713 - DNA, 201 bp, Homo sapiens
cccacagtgtaggcattcaacaaacgctcttcagggagaaggaaagttaccatcaaaatccgtcgttgaaagtattgaagttccagctggcggtctgatayagcttagatgttgtccctgcccaaagctcatgtcaaaaggtaatctgcagcgttggaggtggggcatggtgggaggtgattgggtcatgggggtggattt

SEQ ID NO: 30714 - DNA, 201 bp, Homo sapiens
aatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgc

SEQ ID NO: 30715 - DNA, 201 bp, Homo sapiens
acatatgtattcattcattcattcatttattctttcattcagtcaataaatatttattgagtagtaagcacatgcaaggcattgagggtggggagggaaaragacacaaattgtccttaccctcatggattcaccatctatttaaaggccacaaatacttgtgtgagaagcaagtcttaatagtctgaagtattttcttag

SEQ ID NO: 30716 - DNA, 201 bp, Homo sapiens
ttcagtcaataaatatttattgagtagtaagcacatgcaaggcattgagggtggggagggaaaaagacacaaattgtccttaccctcatggattcaccatstatttaaaggccacaaatacttgtgtgagaagcaagtcttaatagtctgaagtattttcttagattcccttgagccgcaatgctgaaaagcttatggtgg

SEQ ID NO: 30717 - DNA, 201 bp, Homo sapiens
ggagggaaaaagacacaaattgtccttaccctcatggattcaccatctatttaaaggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccat

SEQ ID NO: 30718 - DNA, 201 bp, Homo sapiens
ataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctg

SEQ ID NO: 30719 - DNA, 201 bp, Homo sapiens
gcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagaga

SEQ ID NO: 30720 - DNA, 201 bp, Homo sapiens
ttgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactgacccaaatcacacgtcacggctcttcgcccattaacgcttata

SEQ ID NO: 30721 - DNA, 201 bp, Homo sapiens
catcaatataagccccataaaaggcaaagtggttgaggagaaacgagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaa

SEQ ID NO: 30722 - DNA, 201 bp, Homo sapiens
cacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggag

SEQ ID NO: 30723 - DNA, 201 bp, Homo sapiens
aggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaatt

SEQ ID NO: 30724 - DNA, 201 bp, Homo sapiens
tgctggcgagtgtaccctttctgcagaaagtaaaaatggccttgctgaggaaattaaattcctgttcgagtgctatttctttatggcactgaggagcaagyatttctaacaatcatattgcttaagaagtggatggcaagaagataattactaatatgtctgcaattgatctgaaattgacacagttgatctcactgattc

SEQ ID NO: 30725 - DNA, 201 bp, Homo sapiens
ttagatgctcttagttaaagaccatgcaaaaaggatgaaatcttttgatcatgttcttcacaatattagaggtaaaacatgaactcaacgcttttaggaaraaacaactggattgcgttttctattttattgacagaaactagatggggaggccagggtgtgttttattattgcacacatacgtaattacaaagtctttgc

SEQ ID NO: 30726 - DNA, 201 bp, Homo sapiens
aagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagtaccccagccatagaaagtgagagctttcgaagaatctgtggttagaacta

SEQ ID NO: 30727 - DNA, 201 bp, Homo sapiens
caggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaat

SEQ ID NO: 30728 - DNA, 201 bp, Homo sapiens
cttctctttatggatttccctttggaagcagggataagaagagggaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcac

SEQ ID NO: 30729 - DNA, 201 bp, Homo sapiens
agggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaaga

SEQ ID NO: 30730 - DNA, 201 bp, Homo sapiens
ttggatgcaattgcccccaaattatcgaagagaaaagaagaccactgtaattcaccggccatagcatttttaccaactgtttttgctaagcattagtttcktgtgataggttcaattctcaggctccttctcattagagtctttctgtaaagaccattattatttctgttatatttcctgtggctgagctgagccgcactt

SEQ ID NO: 30731 - DNA, 201 bp, Homo sapiens
aaaagaagaccactgtaattcaccggccatagcatttttaccaactgtttttgctaagcattagtttcttgtgataggttcaattctcaggctccttctcrttagagtctttctgtaaagaccattattatttctgttatatttcctgtggctgagctgagccgcacttggagatttgatccattttaactctctcattgc

SEQ ID NO: 30732 - DNA, 201 bp, Homo sapiens
aagaagaccactgtaattcaccggccatagcatttttaccaactgtttttgctaagcattagtttcttgtgataggttcaattctcaggctccttctcatyagagtctttctgtaaagaccattattatttctgttatatttcctgtggctgagctgagccgcacttggagatttgatccattttaactctctcattgcct

SEQ ID NO: 30733 - DNA, 201 bp, Homo sapiens
catttttaccaactgtttttgctaagcattagtttcttgtgataggttcaattctcaggctccttctcattagagtctttctgtaaagaccattattattkctgttatatttcctgtggctgagctgagccgcacttggagatttgatccattttaactctctcattgccttcagagagttggtgattttggggggggcac

SEQ ID NO: 30734 - DNA, 201 bp, Homo sapiens
catttactcacctgttgtatcatctgaattatttccatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtg

SEQ ID NO: 30735 - DNA, 201 bp, Homo sapiens
gatgaatgtagtgagagaaggaaggaagagagagagggaagaaggggaaaaagagggatggaaaggaggaaggaaggaaaggagggaggaggcaagtatawtagtcatgatatagggaattgaaaagacattcacgttttgtggtgaatgaaaataacttgacctttatgaagctggcctaatccctggaaggaaaaaatt

SEQ ID NO: 30736 - DNA, 201 bp, Homo sapiens
gagaaggaaggaagagagagagggaagaaggggaaaaagagggatggaaaggaggaaggaaggaaaggagggaggaggcaagtatattagtcatgatatakggaattgaaaagacattcacgttttgtggtgaatgaaaataacttgacctttatgaagctggcctaatccctggaaggaaaaaatttccttggatatgtg

SEQ ID NO: 30737 - DNA, 201 bp, Homo sapiens
gggaagaaggggaaaaagagggatggaaaggaggaaggaaggaaaggagggaggaggcaagtatattagtcatgatatagggaattgaaaagacattcacrttttgtggtgaatgaaaataacttgacctttatgaagctggcctaatccctggaaggaaaaaatttccttggatatgtgatttatataatcaatcaacta

SEQ ID NO: 30738 - DNA, 201 bp, Homo sapiens
ttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtgtgtaaaattcaaatttcaatgaagattgtgtattt

SEQ ID NO: 30739 - DNA, 201 bp, Homo sapiens
tgggtttactcaccgtatctgtgtgcatcctggcaatgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtac

SEQ ID NO: 30740 - DNA, 201 bp, Homo sapiens
tactcctctccgtacactttggacatgtcaaaatctagaaatagagatcagtaaaggtaacacatagcaccttaaatctgatttaaaaggaaaacaatgaytattatacagatttatggcttcttgtcaataatactctgatttctggagattgttatcagtcataagctttataggaaatatctccttttgaaaatgaca

SEQ ID NO: 30741 - DNA, 201 bp, Homo sapiens
tccgtacactttggacatgtcaaaatctagaaatagagatcagtaaaggtaacacatagcaccttaaatctgatttaaaaggaaaacaatgactattatasagatttatggcttcttgtcaataatactctgatttctggagattgttatcagtcataagctttataggaaatatctccttttgaaaatgacattttaaat

SEQ ID NO: 30742 - DNA, 201 bp, Homo sapiens
ggaaaacaatgactattatacagatttatggcttcttgtcaataatactctgatttctggagattgttatcagtcataagctttataggaaatatctcctwttgaaaatgacattttaaattaatgtgaaattgtgttttaatttaattcacagggagtcataaacaggtgggagaattatggaacaataattgtgtttgc

SEQ ID NO: 30743 - DNA, 201 bp, Homo sapiens
acaatgactattatacagatttatggcttcttgtcaataatactctgatttctggagattgttatcagtcataagctttataggaaatatctccttttgamaatgacattttaaattaatgtgaaattgtgttttaatttaattcacagggagtcataaacaggtgggagaattatggaacaataattgtgtttgcaagaa

SEQ ID NO: 30744 - DNA, 201 bp, Homo sapiens
ttataggaaatatctccttttgaaaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaa

SEQ ID NO: 30745 - DNA, 201 bp, Homo sapiens
tgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaact

SEQ ID NO: 30746 - DNA, 201 bp, Homo sapiens
gcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgcc

SEQ ID NO: 30747 - DNA, 201 bp, Homo sapiens
tggccatggtgctcacagtctctcaatcctttatgttgagggagaaatgataaccagatctcattttgtgtgccaacccgaaagcctgacttgactgcctmaaatgttaggaaggactctaaagccctatctggattccaaatttatggttggtgcagactggatttttacaatttgtgcttagtagtatcttattatatt

SEQ ID NO: 30748 - DNA, 201 bp, Homo sapiens
tgctcacagtctctcaatcctttatgttgagggagaaatgataaccagatctcattttgtgtgccaacccgaaagcctgacttgactgcctaaaatgttargaaggactctaaagccctatctggattccaaatttatggttggtgcagactggatttttacaatttgtgcttagtagtatcttattatattagcccggca

SEQ ID NO: 30749 - DNA, 201 bp, Homo sapiens
gccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgt

SEQ ID NO: 30750 - DNA, 201 bp, Homo sapiens
ctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaata

SEQ ID NO: 30751 - DNA, 201 bp, Homo sapiens
atttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctggcgtgcgta

SEQ ID NO: 30752 - DNA, 201 bp, Homo sapiens
gtgttttagatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaactt

SEQ ID NO: 30753 - DNA, 201 bp, Homo sapiens
gcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttc

SEQ ID NO: 30754 - DNA, 201 bp, Homo sapiens
acgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaaaaaaaaaaattagccaggcgtgggggtgcatgcctgtgctcc

SEQ ID NO: 30755 - DNA, 201 bp, Homo sapiens
gtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagcta

SEQ ID NO: 30756 - DNA, 201 bp, Homo sapiens
cagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtagaaggaacctggatttctatttttttaaaaaatataat

SEQ ID NO: 30757 - DNA, 201 bp, Homo sapiens
ccggctgactagaatgttgacgttaaagcagttagagtccgagcaggcaactccgaccccaagttggagctgtgtgttgaagatagaagagcaaatatgtrgaaggaacctggatttctatttttttaaaaaatataataaatcatccagccccaaatgtcaggaacctgggtttctaatgatggttggctgtcaccccca

SEQ ID NO: 30758 - DNA, 201 bp, Homo sapiens
gcagttagagtccgagcaggcaactccgaccccaagttggagctgtgtgttgaagatagaagagcaaatatgtagaaggaacctggatttctatttttttwaaaaatataataaatcatccagccccaaatgtcaggaacctgggtttctaatgatggttggctgtcacccccatttcccacactttaaatgagagaagta

SEQ ID NO: 30759 - DNA, 201 bp, Homo sapiens
tccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgc

SEQ ID NO: 30760 - DNA, 201 bp, Homo sapiens
ttctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcag

SEQ ID NO: 30761 - DNA, 201 bp, Homo sapiens
tgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaacgttggatcatg

SEQ ID NO: 30762 - DNA, 201 bp, Homo sapiens
atctcaaaaaaacatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttct

SEQ ID NO: 30763 - DNA, 201 bp, Homo sapiens
cttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggcc

SEQ ID NO: 30764 - DNA, 201 bp, Homo sapiens
gacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacata

SEQ ID NO: 30765 - DNA, 201 bp, Homo sapiens
gtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatc

SEQ ID NO: 30766 - DNA, 201 bp, Homo sapiens
aagatcctcaagctgttccttccaccccctgggatgctgattaagttaagatttcagattttatttattctacgggtatttgttgaatatttatttcttamgataccacgcactgctttaggcactgggaatatagcaggatatacaaaacagaaaaatcatggccctcatggattattggttgtgagtaataggaacctt

SEQ ID NO: 30767 - DNA, 201 bp, Homo sapiens
tcctcaagctgttccttccaccccctgggatgctgattaagttaagatttcagattttatttattctacgggtatttgttgaatatttatttcttacgatrccacgcactgctttaggcactgggaatatagcaggatatacaaaacagaaaaatcatggccctcatggattattggttgtgagtaataggaacctttcaa

SEQ ID NO: 30768 - DNA, 201 bp, Homo sapiens
cactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtg

SEQ ID NO: 30769 - DNA, 201 bp, Homo sapiens
cccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaacc

SEQ ID NO: 30770 - DNA, 201 bp, Homo sapiens
tgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatct

SEQ ID NO: 30771 - DNA, 201 bp, Homo sapiens
aaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcacca

SEQ ID NO: 30772 - DNA, 201 bp, Homo sapiens
atatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgagagttacatcaggggagggtcatgaggtcacctt

SEQ ID NO: 30773 - DNA, 201 bp, Homo sapiens
ccgtttctgcttcttcccagggtgtgacctcagcggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggag

SEQ ID NO: 30774 - DNA, 201 bp, Homo sapiens
agatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagaca

SEQ ID NO: 30775 - DNA, 201 bp, Homo sapiens
caggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaact

SEQ ID NO: 30776 - DNA, 201 bp, Homo sapiens
tgatgcacccgcatcggcctcccaaagtgctgggattacaggcatgagccaccgcacctggaggacaagtaatttctaagtattatttcttttaatcctcrcagtgactccttgttagggtttgctgcattttatacaaagaagaaaggagtctgtggaagtgacataaagtaggacatgtattcatttactgattcaacc

SEQ ID NO: 30777 - DNA, 201 bp, Homo sapiens
cccaaagtgctgggattacaggcatgagccaccgcacctggaggacaagtaatttctaagtattatttcttttaatcctcacagtgactccttgttagggwttgctgcattttatacaaagaagaaaggagtctgtggaagtgacataaagtaggacatgtattcatttactgattcaacctttcatttgtacatatatgt

SEQ ID NO: 30778 - DNA, 201 bp, Homo sapiens
gctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagt

SEQ ID NO: 30779 - DNA, 201 bp, Homo sapiens
tgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgag

SEQ ID NO: 30780 - DNA, 201 bp, Homo sapiens
ggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaa

SEQ ID NO: 30781 - DNA, 201 bp, Homo sapiens
ggctgttgatggcaagaaaagaagggtgatgggttgggcttatattgtttagtggagcaaaacagatgtgaaacatttgtgtcttaaagtgttttggtcargagaaactaaattggttagaaagtgtgcaattttgcaagctttataaaaatataaaccaatgagtctggactctgttccctaaaggggatgaggaatgaa

SEQ ID NO: 30782 - DNA, 201 bp, Homo sapiens
tccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactc

SEQ ID NO: 30783 - DNA, 201 bp, Homo sapiens
gtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcag

SEQ ID NO: 30784 - DNA, 201 bp, Homo sapiens
ggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattc

SEQ ID NO: 30785 - DNA, 201 bp, Homo sapiens
aagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaac

SEQ ID NO: 30786 - DNA, 201 bp, Homo sapiens
attttttcctgtgcagcaattttaactttctatattcaaatatactctgaatgcacagtgaatttggcagaataccatttaagtcttgtattttccaaagytagtcaacgtccaactgccaatgttgcctgaacaggaaatatttatacctgaaagcgtccaggtgagagtcaggaaagccatgaaggtgcaactggcata

SEQ ID NO: 30787 - DNA, 201 bp, Homo sapiens
tgtgcagcaattttaactttctatattcaaatatactctgaatgcacagtgaatttggcagaataccatttaagtcttgtattttccaaagctagtcaacrtccaactgccaatgttgcctgaacaggaaatatttatacctgaaagcgtccaggtgagagtcaggaaagccatgaaggtgcaactggcatactgatgtca

SEQ ID NO: 30788 - DNA, 201 bp, Homo sapiens
ctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttatttacagtt

SEQ ID NO: 30789 - DNA, 201 bp, Homo sapiens
aaaaaccctacttttgactttataatattaagttcgttcatatctctcttagattcttatataaattttattgacctaatgttctgtacagtagtccttawttacagttttggtttccaaggtttcagttatacattgtcaactgtggtacaaatatattacttacaatacgatattttgagagagagagaccacatttat

SEQ ID NO: 30790 - DNA, 201 bp, Homo sapiens
atctctcttagattcttatataaattttattgacctaatgttctgtacagtagtccttatttacagttttggtttccaaggtttcagttatacattgtcamctgtggtacaaatatattacttacaatacgatattttgagagagagagaccacatttatgtaacttttattacaatttattgttataattgttctattat

SEQ ID NO: 30791 - DNA, 201 bp, Homo sapiens
ttgacctaatgttctgtacagtagtccttatttacagttttggtttccaaggtttcagttatacattgtcaactgtggtacaaatatattacttacaataygatattttgagagagagagaccacatttatgtaacttttattacaatttattgttataattgttctattattgttgctcatctcttactgtgcctaattt

SEQ ID NO: 30792 - DNA, 201 bp, Homo sapiens
taatttataagtatactttattgtaggtatgtatgtataggaagaaatgaaatatatgtagggtttggaaccatctgaggctttaggcatctactgggggwcttggagtatatcccctgtgcagaagcggaggctactgtacatacatttgcctgtaagtgagcgcgttcttggattttgttgaatggtgccactgattat

SEQ ID NO: 30793 - DNA, 201 bp, Homo sapiens
aagaaatgaaatatatgtagggtttggaaccatctgaggctttaggcatctactgggggtcttggagtatatcccctgtgcagaagcggaggctactgtayatacatttgcctgtaagtgagcgcgttcttggattttgttgaatggtgccactgattatgggtcagagcttgttgaaagggtattaatccattatttact

SEQ ID NO: 30794 - DNA, 201 bp, Homo sapiens
gtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagt

SEQ ID NO: 30795 - DNA, 201 bp, Homo sapiens
gtctcccatttcagagacaggggcatttggctccaggtttttctgactctagacagtagtttgtttttagcacatcaaatgtctgagacttgtgatgtgtyagaaagcacaaaggactttgatcacaagatcaagccccagagggccatgactgcataaaccacaacaactgcgtggctgcctgtcacgtcttcatctgca

SEQ ID NO: 30796 - DNA, 201 bp, Homo sapiens
tgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgcctggctaattttct

SEQ ID NO: 30797 - DNA, 201 bp, Homo sapiens
gtgcggtcacagctcactacagcttcaacctcctgggatcaagcagtcttcttgccttagccacccgagtagctggatgacaggtgagcaccaccatgccyggctaattttctaaattttttgtagagacaaggtctcactgtgttgtccaggctggtctcaaactcctgagctcaagtgatcctcccgcctcgacctctc

SEQ ID NO: 30798 - DNA, 201 bp, Homo sapiens
tgcggtcacagctcactacagcttcaacctcctgggatcaagcagtcttcttgccttagccacccgagtagctggatgacaggtgagcaccaccatgcctrgctaattttctaaattttttgtagagacaaggtctcactgtgttgtccaggctggtctcaaactcctgagctcaagtgatcctcccgcctcgacctctca

SEQ ID NO: 30799 - DNA, 201 bp, Homo sapiens
gattcctgttttacatattaaaaatttcatctctccaatcttcgaagaatccgtagtccatttttaagtagctcttgtcttccaaaggtatgggatgtgcmtacctaatgctcttcctggatgggagaatattaccaaaaacgtttggtcgactaattttatgacagtttccaactacaatttttttcctctttgctttct

SEQ ID NO: 30800 - DNA, 201 bp, Homo sapiens
tgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactaatgca

SEQ ID NO: 30801 - DNA, 201 bp, Homo sapiens
tactcttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagct

SEQ ID NO: 30802 - DNA, 201 bp, Homo sapiens
ctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagatcagtaatttataggctgacattttccttgggtccttataatacttgtttat

SEQ ID NO: 30803 - DNA, 201 bp, Homo sapiens
tagaagagactctggggaatccagagtcttggtcacgggtacatcaaaacgacgctggtgcctaacttctagttccagacaaagaaggagagagagagagrtcagtaatttataggctgacattttccttgggtccttataatacttgtttattacagataatttgcttaagtgtgcacaaggtggaaggtcacgcaagga

SEQ ID NO: 30804 - DNA, 201 bp, Homo sapiens; identical to SEQ ID NO: 8577

SEQ ID NO: 30805 - DNA, 201 bp, Homo sapiens; identical to SEQ ID NO: 8578

SEQ ID NO: 30806 - DNA, 201 bp, Homo sapiens; identical to SEQ ID NO: 8579

SEQ ID NO: 30807 - DNA, 201 bp, Homo sapiens; identical to SEQ ID NO: 8580

SEQ ID NO: 30808 - DNA, 201 bp, Homo sapiens; identical to SEQ ID NO: 8581

SEQ ID NO: 30809 - DNA, 201 bp, Homo sapiens; identical to SEQ ID NO: 8582

SEQ ID NO: 30810 - DNA, 201 bp, Homo sapiens; identical to SEQ ID NO: 8583

SEQ ID NO: 30811 - DNA, 201 bp, Homo sapiens; identical to SEQ ID NO: 8584

SEQ ID NO: 30812 - DNA, 201 bp, Homo sapiens; identical to SEQ ID NO: 8585

SEQ ID NO: 30813 - DNA, 201 bp, Homo sapiens; identical to SEQ ID NO: 8586

SEQ ID NO: 30814 - DNA, 201 bp, Homo sapiens; identical to SEQ ID NO: 8587

SEQ ID NO: 30815 - DNA, 201 bp, Homo sapiens; identical to SEQ ID NO: 8588

SEQ ID NO: 30816 - DNA, 201 bp, Homo sapiens; identical to SEQ ID NO: 8589

SEQ ID NO: 30817 - DNA, 201 bp, Homo sapiens; identical to SEQ ID NO: 8590

SEQ ID NO: 30818 - DNA, 201 bp, Homo sapiens; identical to SEQ ID NO: 8591

SEQ ID NO: 30819 - DNA, 201 bp, Homo sapiens; identical to SEQ ID NO: 8592

SEQ ID NO: 30820 - DNA, 201 bp, Homo sapiens; identical to SEQ ID NO: 8593

SEQ ID NO: 30821 - DNA, 201 bp, Homo sapiens; identical to SEQ ID NO: 8594

SEQ ID NO: 30822 - DNA, 201 bp, Homo sapiens; identical to SEQ ID NO: 8595

SEQ ID NO: 30823 - DNA, 201 bp, Homo sapiens; identical to SEQ ID NO: 8596

SEQ ID NO: 30824 - DNA, 201 bp, Homo sapiens; identical to SEQ ID NO: 8597

SEQ ID NO: 30825 - DNA, 201 bp, Homo sapiens; identical to SEQ ID NO: 8598

SEQ ID NO: 30826 - DNA, 201 bp, Homo sapiens; identical to SEQ ID NO: 8599

SEQ ID NO: 30827 - DNA, 201 bp, Homo sapiens; identical to SEQ ID NO: 8600

SEQ ID NO: 30828 - DNA, 201 bp, Homo sapiens; identical to SEQ ID NO: 8601

SEQ ID NO: 30829 - DNA, 201 bp, Homo sapiens; identical to SEQ ID NO: 8602

SEQ ID NO: 30830 - DNA, 201 bp, Homo sapiens; identical to SEQ ID NO: 8603

SEQ ID NO: 30831 - DNA, 201 bp, Homo sapiens; identical to SEQ ID NO: 8604

SEQ ID NO: 30832 - DNA, 201 bp, Homo sapiens; identical to SEQ ID NO: 8605

SEQ ID NO: 30833 - DNA, 201 bp, Homo sapiens; identical to SEQ ID NO: 8606

SEQ ID NO: 30834 - DNA, 201 bp, Homo sapiens; identical to SEQ ID NO: 8607

SEQ ID NO: 30835 - DNA, 201 bp, Homo sapiens
agaccctgtctctgaaaaataaaaataaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtt

SEQ ID NO: 30836 - DNA, 201 bp, Homo sapiens
gcacacacacacttttaagcatttttgatttatatatccctctgcatattttgtgccttgtgatgtgtttaacgaatgacagtgtctttagtgcattgctrcttggggtttctacactggaagtgtaatccgaggccttggaattggtcaaacaaaactcacttggcaacatttacttagagagcactctgcgagcactct

SEQ ID NO: 30837 - DNA, 201 bp, Homo sapiens
cacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaat

SEQ ID NO: 30838 - DNA, 201 bp, Homo sapiens
tttacattatacttaggctggtgttaggatgccgtggctgccaagtttacacaatgcactttctctctctctttcttcttttggtttatgatgtttttcartagtgtcatggaactcacttaatctgatttcatcaagtaaatatatgggaagttgagatgacatatttttatctgacatttgaagaaatattcataaaat

SEQ ID NO: 30839 - DNA, 201 bp, Homo sapiens
tctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttg

SEQ ID NO: 30840 - DNA, 201 bp, Homo sapiens
tgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccag

SEQ ID NO: 30841 - DNA, 201 bp, Homo sapiens
caaatgaatgaatgtatgagtgggtcaagaacaagattcggccccaaggagatacgcgactttctactttgttttctatttggatttcacacaaaggctckaaggtctcctggtaggccatgctcagaagtctgggttgtcccctgcccaggacaggctcaccctggcctgtgtcctaggtattgtggggccgctgtagga

SEQ ID NO: 30842 - DNA, 201 bp, Homo sapiens
acatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgt

SEQ ID NO: 30843 - DNA, 201 bp, Homo sapiens
atctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagct

SEQ ID NO: 30844 - DNA, 201 bp, Homo sapiens
ctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggt

SEQ ID NO: 30845 - DNA, 201 bp, Homo sapiens
gccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttct

SEQ ID NO: 30846 - DNA, 201 bp, Homo sapiens
tcttattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattct

SEQ ID NO: 30847 - DNA, 201 bp, Homo sapiens
ttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgt

SEQ ID NO: 30848 - DNA, 201 bp, Homo sapiens
aggaagaactcttccaaatgatggcagggatatttggaatctttccccctgagttccctctggaagttaaagcccagatcccgtgaactgattaaaaagcyccagaccattcccgttccagtcatcttgaaactgagcaagaccgtgtcatccatggagcttgaacataggagcactttaaaaaaaaaaagaatgaaaagc

SEQ ID NO: 30849 - DNA, 201 bp, Homo sapiens
ggaagaactcttccaaatgatggcagggatatttggaatctttccccctgagttccctctggaagttaaagcccagatcccgtgaactgattaaaaagccscagaccattcccgttccagtcatcttgaaactgagcaagaccgtgtcatccatggagcttgaacataggagcactttaaaaaaaaaaagaatgaaaagcc

SEQ ID NO: 30850 - DNA, 201 bp, Homo sapiens
cttcccacaattcccagtgagcccaactccttaccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcccattccttc

SEQ ID NO: 30851 - DNA, 201 bp, Homo sapiens
ccactccttcccacaattcccagtgaaccccacttgtgtagtgtgtctgtgagtagtctgcccactctccttatgacaggtttccagtattatctgtttcmtaacccatttccaaccttctgggttttttccttcaacgtttcctgtgacagttctccattatatctttgttagataatagttagcaacccattaataact

SEQ ID NO: 30852 - DNA, 201 bp, Homo sapiens
tgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcagg

SEQ ID NO: 30853 - DNA, 201 bp, Homo sapiens
gtcctccctccttggcctcccaatctgctgagattacaggaccctgctgatgtcttaatcttagccccttcagatcccagttggtcttctgactccagagstataaaagaataaatgtgtgttatttcaagccgtgaatttcttattaatgtgtcacatagcaatggaaaaataaacgttctatgccatttttatcacatg

SEQ ID NO: 30854 - DNA, 201 bp, Homo sapiens
aacctccaccacgaaggttccagacagagtgaaatttctgtatttgctgaccctgtcgccagtagcctggaataaacagcaaaaatagttcttgaggcttygtggcaaatgtgacctacctttgtagttcttgggtaggtgtgtgactgtggcctatgaggccaagttgcaaggtctttggatgaactttgtggcatctgg

SEQ ID NO: 30855 - DNA, 201 bp, Homo sapiens
aaacttttaaaaaaattaattttgtgaattaaataaagcagcatgcaaatttactatcgtattcagcaaccaaaattttatcacttgcctgatactgcctrgtgagcaggtggaaatgtagacacccaaacacccttcatggattcccagctgctgagagtttgaatagtatgtgaagtctgtagagacaaaattgttgtt

SEQ ID NO: 30856 - DNA, 201 bp, Homo sapiens
cttttgaaggtggtttgtttttttattcctttataagtacagttgtagatttacaaagtaattgagtatatagtacataaggtcttgtgtacccaccgatygcaattgagcatatagtacatgctgtcctgtgtacccactgatccctggtcctgcccctggtatgagggtattaacatcttgcattagtgtggcacattt

SEQ ID NO: 30857 - DNA, 201 bp, Homo sapiens
gatcactgagtgtgccttttgctctgttaagtgtgcattcagaactttactaacatgggttccacaggaaatattagccccattttgcaaatgaagaggcwgaggctcagaaatttaaaattgcttcatgtcgcacagttcagtgtaaagttgcaatgcaaactaagatgtttctgttgcttataatcttaactataataa

SEQ ID NO: 30858 - DNA, 201 bp, Homo sapiens
attcggctccactcactctccattgtctgcatgcctaattcttcctggttgtgagacaagcagttggacctagctgagctaaggagcagaaagactgtatsacagggaacttgtgtaacagcttgatctcctgtcctacgtagctatctattggtaagaagttgaaggaacttgtgtcattccgttgtgcctgtcgtcttg

SEQ ID NO: 30859 - DNA, 201 bp, Homo sapiens
ataaatgtggaaaacaatgtatatgtgttttttatctctcaatgattggtgggtaccatatccccaaagtagaatgagcatttgagaaaacaggaaatatyctcttttaggcaccatctctgtcaaggctgatgctgggctttttatatattttctctaattcttgtggctgtcaaacaaggtgggcattatcattccctt

SEQ ID NO: 30860 - DNA, 201 bp, Homo sapiens
gtgacggtcctttcaaatttaaaggaatagctgatggtcactggccacccaagctgatactgattttatatgttgatgtttctcattttatttgctctttscttgaatatttattcaggacattctctaccagacatattgagtaagggcaacagaaacaatacataagtatcttataaatgtggaaaacaatgtatatgt

SEQ ID NO: 30861 - DNA, 201 bp, Homo sapiens
gtatgtactgatgttctggaattcactataagaagttgcaaatggtgcatgaaatgaaaaattcctggtggtctccaggggacacagccggtgctgtgctscactctgggtaactgttttggattattttctctattccaactgaaataaaaaaaaattaattaaatgtggctaggttatcttgacagcagaatccattcc

SEQ ID NO: 30862 - DNA, 201 bp, Homo sapiens
gtccccaggaagccagaacacagggcagtaaagtgctgaatgcaaagggcaggagaaaaatggaaacaaccagaactgtaacaccaaggaatgagacctgyatgtcagatatcatgcccattgcactaagtgccattggggcacaattatcaaatggatgcattttccctagaaaaccatcttggagagcatgtggatgta

SEQ ID NO: 30863 - DNA, 201 bp, Homo sapiens
tgttgagaagctaattcttgtcagcctaaaaacttgaatatacatttgaataaatcagcggtgctacaccgtggcagcctgctgaaaatccccaaggaagrttatatttttagttgagctacttgtcactgcactgtgtttttaatattgtgagtcctttcttgtcttcatttttgaagaatctattgcataccttgtcat

SEQ ID NO: 30864 - DNA, 201 bp, Homo sapiens
aagtacaaggaaggggatgagtggctggctggctagatggatagaaagatggaacaggtaagtataaggaaggggataggtggctggctggctagatggayggaaggggtggaaggggatgcaagaggtaagtacaaggaaggggatgggtggctggctggctagatggatagaaggttggaagacaggaaggatggaacg

SEQ ID NO: 30865 - DNA, 201 bp, Homo sapiens
ttttacttcattaaactgagctccagaggagcagaaactttggctaatacatcttggtcttagcttgtaatatctgtgctacaacttattaagatggtgaygctggcaaattccttaatctttctaattcttaatttcatcagcaaagatgggaaaggatactaacaccactctgggttgttgagaggattcaataactga

SEQ ID NO: 30866 - DNA, 201 bp, Homo sapiens
cctgctcttacccgggcaccacagttgatgagttattttttggaccatcagcaacacacccaatcattgtacatggaatacttcggggatgcttttttctrtattgattttacttcattaaactgagctccagaggagcagaaactttggctaatacatcttggtcttagcttgtaatatctgtgctacaacttattaaga

SEQ ID NO: 30867 - DNA, 201 bp, Homo sapiens
tggcgtgatcactctcaagtgcaaacccagccctgacactgtcctgtttggcaatgtcctgctatctgacctgcaaatagctacacttcctgctgtggccsacccaggcctctgggatctgatcccttctcccatgtcacctgtggccatgtcttccccaacccaggcttctctgctccgctgcttatgttctggatcctg

SEQ ID NO: 30868 - DNA, 201 bp, Homo sapiens
cagactaagaaattaagaacctcaaccaagttcatgctagctggtacgcagtaaggctagaacttcgtccaaaatctcttcttctgttgagctcagcttgyatagtagcttggagaatcagaaagatctgtctcatttgggaaatataccatgtaaaaaacattgtttctaaaggagatttgtcccatgagtaaaatagat

SEQ ID NO: 30869 - DNA, 201 bp, Homo sapiens
caactaagtgctgtttcaataacgaagatactgaagcgctaattggagtatggaaccatataatgatgataataattgctaatatttatcagctatttatyatgtgtcatgtacagctaagcacttacataccatcccattttatccttataatgactctaagagtgggttaaaaaatggcagaagaatggcagtgtttaa

SEQ ID NO: 30870 - DNA, 201 bp, Homo sapiens
caaagaatcagatagtaaatatttttgctcttatcagccagacagtctctgcggcaaccattcaagcattgttgaatacattgttgagtgttacatgagaytattgtaatataaaagtagcctgggacaacacataaataactgggtgtggctgtgtcctaataaaactttatttacaaagaacaggaagtggcttggatt

SEQ ID NO: 30871 - DNA, 201 bp, Homo sapiens
ccatattaaaagtcatcactgccaagacataaatgaaaatgtgttcgaattaaccacaccaatgttcacaaaataaacatttttgatttcccaacagaatmctaggtttaactatcactatcatctttcatgaaatcaaagtcatatatgtaaattgaacacaactttcccttccatagagagtaaaaaccacgctttgga

SEQ ID NO: 30872 - DNA, 201 bp, Homo sapiens
atggaaatggatgatcatggcagtgttgcaataaaactttacaaaacagacaatgggccagattggccaggggccatagtatgctacccctgggcaacaamctgtatgccctggagtagtgtaaagaacgtgggtgttgggggtcaactgacgcttccagctctaccacttactggctgtgtggctttgggcaaactactg

SEQ ID NO: 30873 - DNA, 201 bp, Homo sapiens
cttcttgtaaggggccagagagtgaatatttgagaattttcagactattaagatctctgttgcaactgcttgcttttgccgtggtagcctgaaagcagccrtagatagtatggaaatggatgatcatggcagtgttgcaataaaactttacaaaacagacaatgggccagattggccaggggccatagtatgctacccctg

SEQ ID NO: 30874 - DNA, 201 bp, Homo sapiens
cttcccaaaaacatcaaagtatgaccgtaaagggcagaggtaggtaaacttcttgtaaggggccagagagtgaatatttgagaattttcagactattaagwtctctgttgcaactgcttgcttttgccgtggtagcctgaaagcagccgtagatagtatggaaatggatgatcatggcagtgttgcaataaaactttacaa

SEQ ID NO: 30875 - DNA, 201 bp, Homo sapiens
ctgaaatagatcatacactctcttcccaaaaacatcaaagtatgaccgtaaagggcagaggtaggtaaacttcttgtaaggggccagagagtgaatatttragaattttcagactattaagatctctgttgcaactgcttgcttttgccgtggtagcctgaaagcagccgtagatagtatggaaatggatgatcatggcag

SEQ ID NO: 30876 - DNA, 201 bp, Homo sapiens
ccctagctcggttttaagaataatgttttagccaacatatctgcattactcttggctcaatatgagaaatccatttttggtttgcctaacagaagatcatsttgctttgcttctctacacagtatgaaaacccaaagaaaagaaaaacagaggcagttttttgctctaatgaatgctctaaatctagctcttaattatgat

SEQ ID NO: 30877 - DNA, 201 bp, Homo sapiens
gattctgttattctccactaagttttctgggtggtcagcccaggaagcctcagcctgcttccagatagttctcctcagagttagcggtagcagcggtcgtyggccagtgtgtctcgggtcaaattattttgggcattactggaaagttccaaaccaaagcctgtggtaagttccacccaaactggcttgtgagggatattt

SEQ ID NO: 30878 - DNA, 201 bp, Homo sapiens
cattctgtctttatagtttgaacttttccttttcatagtctgtaaatattcatcatctcagagccttttgaattgcaatggcttttagtcaaaactgagcrcaatgtgccatttgaataataagaacctcattaaagtgaggcaaaagtaattcttttccttttgtacaagccaattaagtgtctttacaattaaaacaaa

SEQ ID NO: 30879 - DNA, 201 bp, Homo sapiens
tgtggacttgaatcactatccccaggagcctagtaacccacagcttgtggattagtctgttgaactacttgatggcttgtgacccctttttcccttagagktatatgttctgattttcttcttattgatagtggcagctctgtgctttattttgaagggaagcaggggaaccaaaagaaaacttagcagttgtaagttact

SEQ ID NO: 30880 - DNA, 201 bp, Homo sapiens
ggacttactgtattgcctccagtttctctccatttctcaggattggtagcagaaatgggaaacctgatacctagggcaagagaattgcctgaataacagtrtgtggacttgaatcactatccccaggagcctagtaacccacagcttgtggattagtctgttgaactacttgatggcttgtgacccctttttcccttagag

SEQ ID NO: 30881 - DNA, 201 bp, Homo sapiens
tggctctgtcataaggaatcttggcccattgtcactctcattgatgacaacccccgcccccaccactaccaccttaactactgaggggatgtcctctggcycagaaggaatgcattggctctagttgaaggggttgctggtttgtaaatagcatccccacagtcagcagacacagagaatgccatggggccactcatcaga

SEQ ID NO: 30882 - DNA, 201 bp, Homo sapiens
tgttctgcttctggataggccttaggaaacttccaatcatggcgaagaggaagcaggcaaatcttagcaggagcaggaggacgaatagggggaggtgataygctcttgtaaacaagcagatcttaggcatactggatcacgagacagcactagggggatggcactaagctgtttttaaccagccccatgatccaatcacct

SEQ ID NO: 30883 - DNA, 201 bp, Homo sapiens
aagatgctatagggataaataactgctgtggggcaaggactgaaatggttgttgttttgagatggcttttatcattgggccagtgacgacccattcagccstatcagtgaagagtgaagcactgcactctttaaggatagggctgaatggtttatcacccattcagcggtgaccaccacatcttatgcattgtgatgatca

SEQ ID NO: 30884 - DNA, 201 bp, Homo sapiens
taaaagagaatttcctccagatacaatggaggccacgttcaacacagccatctagtgtacctgggcttcttccacctccagccactgtaccgacgtgttcstttatttcacccacatagtgatgatgcttccaacacagcataacaaagagctgctgctttgtgctgctagatttgccaaaagtctgtgccagggattctt

SEQ ID NO: 30885 - DNA, 201 bp, Homo sapiens
gaaaattatagatgcttcagaagatatttgctatcactattaaatgaaaacaagcatgtcatcagtgcttattatttttgttgcttttatgatcaataaayacatgcaaattagagctttttaaatgagattctggaaataagtttttccgtatgtgtaagggaggggtagatacactgccatccaatcagcatcaatggg

SEQ ID NO: 30886 - DNA, 201 bp, Homo sapiens
gtttgactaagagagaaaagaatcactagtcaatgaaagcaactgtgtccccatgcattttccagtgaagatgcgatcacccattgccaccgttaccattrcttaaataatattagaggaattagtgttatgaagtcccacatatgatattgatgaattattaaaccagttgagttagatttctattgtagttcagtgaat

SEQ ID NO: 30887 - DNA, 201 bp, Homo sapiens
ctgttcttcaagaatccccctgcgtccccccgccctgccccctgcccaaaaaaaaggaaatccagggctttgctagggatcatttttggtgtggttctgtrttttaaaatgtggaatcatctccaaaagtgtttgtttattaaaagcaaagtgataaaatgtgtcaagtcagtgaagagactctcaaactcccctttcctg

SEQ ID NO: 30888 - DNA, 201 bp, Homo sapiens
tgaaggttgatgctggatggttgatttgaaggttaggaatggcaaactcagcctctgttcttcaagaatccccctgcgtccccccgccctgccccctgccyaaaaaaaaggaaatccagggctttgctagggatcatttttggtgtggttctgtattttaaaatgtggaatcatctccaaaagtgtttgtttattaaaagc

SEQ ID NO: 30889 - DNA, 201 bp, Homo sapiens
atttattttcaatttctagtttaactgcctcacagtaaaaaagtgtactttttgtgatggcaggaatttgaagtatgttgaaactgcctttgtgatctggstcatggttaacttcaataacgtatgaaaagaatccatatttttatgtgtagtgttctgtagctcttttagttggtttatactcttttaatggtctgttga

SEQ ID NO: 30890 - DNA, 201 bp, Homo sapiens
attttaatagttactctactctcctgatagccactaaagggggaattggatattgtctatcaattggttggtctctgaactaaggctgtatctaattacawggcattgtatcggttctgatttattaaccatttacttggctttggagaaggcagcatttttagtagtactgttgagcctgcatgtagcttttccaggagg

SEQ ID NO: 30891 - DNA, 201 bp, Homo sapiens
tagacacagttcatgaagaacttactatgtgtccagtagataaatataccacaagcattatcttctttaatcatctcacaatcttatgaaggagatactartattttgcttgcaaagatgagggaagtgagtttccgaagttgctaagtgcgtaaaggaggtggtggtgtcagaatgttatcctgctcagatggttgcatg

SEQ ID NO: 30892 - DNA, 201 bp, Homo sapiens
atccctgggagtttggtgaattaatcacccagcatccaaatagctaaccggtagcagagctgggattcaaactcagttaggctgacttctgtgcctgtttycttgcctaagcggtggacgcattgagtaggagaaggccagttattcctctttgtcactgatacaactggggacctgttgccggagatgtggagctgtgca

SEQ ID NO: 30893 - DNA, 201 bp, Homo sapiens
ctgtctttgtgatgttatcataaccttgatttttgagggatagaattgggcataatcagagaaaacgtggtctgggacacatttgtgggctattctatgcyaaacatttccatatcattaatgttcaacacagctttgtggtgttggagataggattatcattgttaggatggttattatcaatactagctgtgattattg

SEQ ID NO: 30894 - DNA, 201 bp, Homo sapiens
atcaaccacttggtcccttcaatctgtaaccttcctgcaacactgtctttgtgatgttatcataaccttgatttttgagggatagaattgggcataatcasagaaaacgtggtctgggacacatttgtgggctattctatgctaaacatttccatatcattaatgttcaacacagctttgtggtgttggagataggattat

SEQ ID NO: 30895 - DNA, 201 bp, Homo sapiens
cctgtagtcccagctactcgggaggctgagaccgaagaattacttgatgaaacatggcagacgacatagaccagcagcaaactaccaacactgtggaggaycccctggatcttaggctcagcccagaggagcgaatttgtgtgaaaatgagaaacgaccgagagcttcgaggcagattacatacttatgatcaacatttaa

SEQ ID NO: 30896 - DNA, 201 bp, Homo sapiens
tgctggtttttgatgatgtattgaaaacttgtataaactggcaattacaactggaaaacatttctagtttagaagagacccttatttttcatatgcttagraatatccagcaagccacttttaaaggctttttatcacattttattcttaagctttctgaattccttattatattttgcctgataaatagttggattttgt

SEQ ID NO: 30897 - DNA, 201 bp, Homo sapiens
tctactctaaatatttaacattcacggatggcatggatcctgactaagcggagcagatgctggctctatattgcacatagctcctgaatatcagccctgcktggctatgcatgtgttttttgttagtttttgagacagagtctcggtctcttgcccaggctggaatgcagtggcacgatgttggctcactgcaaaccctgc

SEQ ID NO: 30898 - DNA, 201 bp, Homo sapiens
gcaggaatgttcaggaagcaggctgcctctgtttctactctaaatatttaacattcacggatggcatggatcctgactaagcggagcagatgctggctctrtattgcacatagctcctgaatatcagccctgcttggctatgcatgtgttttttgttagtttttgagacagagtctcggtctcttgcccaggctggaatgc

SEQ ID NO: 30899 - DNA, 201 bp, Homo sapiens
ggtagaaaactgggatgcccgactgcattggtttagccagaactgtggccatgaaaccttgcctggcccccagggatggggtgaggggggatatcatataygctttaggtggggcagaggggtggtctgcccctgtgcaggcaggaatgttcaggaagcaggctgcctctgtttctactctaaatatttaacattcacgga

SEQ ID NO: 30900 - DNA, 201 bp, Homo sapiens
agtttcagaataataattctgcagaaaaaagtactgattgtccagcagttgtgtcaggtagaaaactgggatgcccgactgcattggtttagccagaactrtggccatgaaaccttgcctggcccccagggatggggtgaggggggatatcatatatgctttaggtggggcagaggggtggtctgcccctgtgcaggcagg

SEQ ID NO: 30901 - DNA, 201 bp, Homo sapiens
cactcagattgcaataggacctgccctgatagcctcattttttacataatcacctctttataggccgtacctccaaatacagtcacattctgaggtagtasgggttaggtcttcagcatatgaattttggggaaacagaatccagctaacaacagttggggatgaggctataacgaataccactgcctaatgtttgcacgg

SEQ ID NO: 30902 - DNA, 201 bp, Homo sapiens
tcctgtgttcagatgtcctcttctttgaaggacaccactcagattgcaataggacctgccctgatagcctcattttttacataatcacctctttataggcygtacctccaaatacagtcacattctgaggtagtaggggttaggtcttcagcatatgaattttggggaaacagaatccagctaacaacagttggggatgag

SEQ ID NO: 30903 - DNA, 201 bp, Homo sapiens
gccgccttcccaccgtgttctcacgtgacctagccgctgtgtgcatgcatccctggtttcttttcctgtgttcagatgtcctcttctttgaaggacaccastcagattgcaataggacctgccctgatagcctcattttttacataatcacctctttataggccgtacctccaaatacagtcacattctgaggtagtaggg

SEQ ID NO: 30904 - DNA, 201 bp, Homo sapiens
cagttgatgtcttctgaggtctccctcgtctgcttgcagacagccgccttcccaccgtgttctcacgtgacctagccgctgtgtgcatgcatccctggttwcttttcctgtgttcagatgtcctcttctttgaaggacaccactcagattgcaataggacctgccctgatagcctcattttttacataatcacctctttat

SEQ ID NO: 30905 - DNA, 201 bp, Homo sapiens
aggctggatgacttgaacaacaaaaatacattttctcatagttgtggagcctagaattccaaggtcaaggtgccggcacagttgatgtcttctgaggtctmcctcgtctgcttgcagacagccgccttcccaccgtgttctcacgtgacctagccgctgtgtgcatgcatccctggtttcttttcctgtgttcagatgtcc

SEQ ID NO: 30906 - DNA, 201 bp, Homo sapiens
aaaataccacaggctggatgacttgaacaacaaaaatacattttctcatagttgtggagcctagaattccaaggtcaaggtgccggcacagttgatgtctwctgaggtctccctcgtctgcttgcagacagccgccttcccaccgtgttctcacgtgacctagccgctgtgtgcatgcatccctggtttcttttcctgtgt

SEQ ID NO: 30907 - DNA, 201 bp, Homo sapiens
ctgctcaggctgccataacaaaataccacaggctggatgacttgaacaacaaaaatacattttctcatagttgtggagcctagaattccaaggtcaaggtkccggcacagttgatgtcttctgaggtctccctcgtctgcttgcagacagccgccttcccaccgtgttctcacgtgacctagccgctgtgtgcatgcatcc

SEQ ID NO: 30908 - DNA, 201 bp, Homo sapiens
cagaggggaaaagaggaagtctgaacgagggccacattgcagatagaggccggtgtactggtctgctcaggctgccataacaaaataccacaggctggatracttgaacaacaaaaatacattttctcatagttgtggagcctagaattccaaggtcaaggtgccggcacagttgatgtcttctgaggtctccctcgtctg

SEQ ID NO: 30909 - DNA, 201 bp, Homo sapiens
ttggcaaatacttccctaaagtggtcatcccattttacattcttgccaacagtgtttaaggatccacttcctctacatccttaataatacttgatattatyggtcttctaaattttctgtttgggtacatagtggtattttgttgtatatatttttttaattgtgaaatatgtgactatgatgagtaatgattttgaacat

SEQ ID NO: 30910 - DNA, 201 bp, Homo sapiens
taaaataaattgcatccatttaaatatacaattcaatgagttttgacagatgcacatgcccatgaaaccaacacgaaaataaaaaaaatagaacatttacrtcacctcaaaaagatttcaaatgccacttctgtggtgtatgactctgagtccagacagcctcagctccaggaaaaccctggtctgttttctgtcactatt

SEQ ID NO: 30911 - DNA, 201 bp, Homo sapiens
acatgaagtcattgtcttaggttggtgatcctagcagctgagcctgggatggggattcttgttcctatgatcgattaggggactgttcccagaggagagcsgagagggaagcaggctttggtttctactggaaatctgtttccgcccgattccatggggagctctggagaaggaattgtatcaccgagttggtcctccttg

SEQ ID NO: 30912 - DNA, 201 bp, Homo sapiens
cggaggctgaggcagcagaatggcttgagcctgggagatcaaggctacagtgagctgcaattgtgccactgcactctaatttaggcagcagaatgagactrtgtctcaagaaaatgttcaagaagaaatacaaactattgaaaaaggaaggctgaatgctttatcagaaaactgtatttagaggggacctttctggggtct

SEQ ID NO: 30913 - DNA, 201 bp, Homo sapiens
agttgaagactagccttggcaacatagcaagacctcatctctacttggaaaaaaaaaattagctgggcatggtggtgctcacctatagtaccaggtacttyggaggctgaggcagcagaatggcttgagcctgggagatcaaggctacagtgagctgcaattgtgccactgcactctaatttaggcagcagaatgagacta

SEQ ID NO: 30914 - DNA, 201 bp, Homo sapiens
tgatgctgagataagtctagatgggataggtgggcaacatgcaggagaaacctcctgggaaaggtgagcaagagcacacaggtgagacatagcatcgagtrtggaaacctccatgggtggcaggtcagtgttgctgagggatgtggacatgtctgaggccaaatagatgagtccctattgggttttgcctctccacaatct

SEQ ID NO: 30915 - DNA, 201 bp, Homo sapiens
tgttgaagacaaggcttagaacatcatcagacccagagcctttctcagaggacctgggagaactctccatatggattttcatttgggaagatagatgctcytattggaacagctggttttccctttaaaacagggagtccagcagcttctaggatgcttagaatcagaattgttgctcactttttaaggtatagagtagtt

SEQ ID NO: 30916 - DNA, 201 bp, Homo sapiens
gaacccagaagactgactctcagaacggaaaactcttggctagaggattccgaaagctagcgtgaagtggaggctattactcagtgggtgccgtaacatgkctgtgtcacctggcacctttttattctctaatctcaggagtgagtgcttcctcctgccgtgcctggccacttctcaccttcagagtctttggtatgcata

SEQ ID NO: 30917 - DNA, 201 bp, Homo sapiens
ttagtcatattcttatcagtatctgaagaacccagaagactgactctcagaacggaaaactcttggctagaggattccgaaagctagcgtgaagtggaggstattactcagtgggtgccgtaacatgtctgtgtcacctggcacctttttattctctaatctcaggagtgagtgcttcctcctgccgtgcctggccacttc

SEQ ID NO: 30918 - DNA, 201 bp, Homo sapiens
tattatggactgaataaatgtttattgaacaaatgccatttttttaactcttaaaatgttcagttcttccaccaaacatagatgacacaactgttggagayggagcaccggactgatgcagtgtagcattattttgtaatctacgaactgggagcctatggagacctatgcatggtggaatacaaaagtcatgacctgtct

SEQ ID NO: 30919 - DNA, 201 bp, Homo sapiens
aaggcagactttagtctggtttataatgctttaatatttttttgaaggaagaaaaatgttcattacttaacgtaataattatttttaaaaagcagcctggsgggggggtattcatttttctgtggctgccataacaaagttcttcaaacttagtgtcttgagacaagacatttattttcttaaagttctggaggtcagagg

SEQ ID NO: 30920 - DNA, 201 bp, Homo sapiens
cagactcaacttacttctagtggtaatggctgtaggagagatggggagtaggagaagaaaagccaaaggcagactttagtctggtttataatgctttaatwtttttttgaaggaagaaaaatgttcattacttaacgtaataattatttttaaaaagcagcctggggggggggtattcatttttctgtggctgccataaca

SEQ ID NO: 30921 - DNA, 201 bp, Homo sapiens
ttttgagctacttccctcctggggagatgcgtgttaactgtttcatgactggcaatgccgtaacagtgagcaagcaatgtgaccttacaaatacatgtgcwgaaatgcagatgagtgggcctaaagaatccagactcaacttacttctagtggtaatggctgtaggagagatggggagtaggagaagaaaagccaaaggca

SEQ ID NO: 30922 - DNA, 201 bp, Homo sapiens
cttccttcacccccaggagcactgaagcagacactgattcctctgcagttgttgggcttttgagctacttccctcctggggagatgcgtgttaactgtttmatgactggcaatgccgtaacagtgagcaagcaatgtgaccttacaaatacatgtgcagaaatgcagatgagtgggcctaaagaatccagactcaacttac

SEQ ID NO: 30923 - DNA, 201 bp, Homo sapiens; identical to SEQ ID NO: 8608

SEQ ID NO: 30924 - DNA, 201 bp, Homo sapiens; identical to SEQ ID NO: 8609

SEQ ID NO: 30925 - DNA, 201 bp, Homo sapiens; identical to SEQ ID NO: 8610

SEQ ID NO: 30926 - DNA, 201 bp, Homo sapiens; identical to SEQ ID NO: 8611

SEQ ID NO: 30927 - DNA, 201 bp, Homo sapiens; identical to SEQ ID NO: 8612

SEQ ID NO: 30928 - DNA, 201 bp, Homo sapiens; identical to SEQ ID NO: 8613

SEQ ID NO: 30929 - DNA, 201 bp, Homo sapiens; identical to SEQ ID NO: 8614

SEQ ID NO: 30930 - DNA, 201 bp, Homo sapiens; identical to SEQ ID NO: 8615

SEQ ID NO: 30931 - DNA, 201 bp, Homo sapiens; identical to SEQ ID NO: 8616

SEQ ID NO: 30932 - DNA, 201 bp, Homo sapiens; identical to SEQ ID NO: 8617

SEQ ID NO: 30933 - DNA, 201 bp, Homo sapiens; identical to SEQ ID NO: 8618

SEQ ID NO: 30934 - DNA, 201 bp, Homo sapiens; identical to SEQ ID NO: 8619

SEQ ID NO: 30935 - DNA, 201 bp, Homo sapiens
tggcacctttttagttttgataagagatatttaccatttattctctctgaggcctatttcctggaggcttcatctgcatcataagaaccttggtctttttrtggacttatcttaacccagatagtcctttctactgatgccaggtgtttagctaataacacttttaaccaattgccaatcagaagatccttgaatctacct

SEQ ID NO: 30936 - DNA, 201 bp, Homo sapiens
cactaggagtctggcacctttttagttttgataagagatatttaccatttattctctctgaggcctatttcctggaggcttcatctgcatcataagaaccktggtctttttgtggacttatcttaacccagatagtcctttctactgatgccaggtgtttagctaataacacttttaaccaattgccaatcagaagatcct

SEQ ID NO: 30937 - DNA, 201 bp, Homo sapiens
tatctgtttcataacccatttccaaccttctgggttttttccttcaacgtttcctgtgacagttctccattatatctttgttagataatagttagcaaccmattaataacttccaactttttgagcctctaccatatcttgttttcactgggatttctacaccgtggctactttgtgggacctgacttatcaagaacttaa

SEQ ID NO: 30938 - DNA, 201 bp, Homo sapiens
ttccatgggttgttatgtgttactggtcaggcgatcagggatttgctgaagattttctttcccatgtggcagtagatatttcagaaccctgcatcatggtrtccacagaagtccccagagttgtatgagagttcatctgggcacctttcccaaaggcaggccccctgtgcagcttcaactattcactctatttataatgtt

SEQ ID NO: 30939 - DNA, 201 bp, Homo sapiens
gtgtgtttccatgggttgttatgtgttactggtcaggcgatcagggatttgctgaagattttctttcccatgtggcagtagatatttcagaaccctgcatsatggtgtccacagaagtccccagagttgtatgagagttcatctgggcacctttcccaaaggcaggccccctgtgcagcttcaactattcactctatttat

SEQ ID NO: 30940 - DNA, 201 bp, Homo sapiens
catttgcgtctcgctgcctgtcttccaaaggatttgccttctagtaattcatgtttttatagcttaactacatttatagtgaacgggtggcttcttcatcsaaagaaagaacaaatgacaaaaagaaaaattttgatgatttgggaaccgcatttatggaataataacattcatgatacctctggataatgacaataatta

SEQ ID NO: 30941 - DNA, 201 bp, Homo sapiens
tgcaggaatatatattcccaccaactttatacaagataatacaaatataatagtatgaataaatatgctaatttgatagaaaatattttaatatttactastagtgtagttggacgtgttaaatattgcaatggttatttgtaatctacctttataaaatttctaatgtctgccactgtttctgttagactcttaagaaga

SEQ ID NO: 30942 - DNA, 201 bp, Homo sapiens
gcttggaaacaggattacttggtgaaataatgtgaatctttcaattctcatgatacatgttttcaacttaatatccagggtgcaggaatatatattcccaycaactttatacaagataatacaaatataatagtatgaataaatatgctaatttgatagaaaatattttaatatttactactagtgtagttggacgtgtta

SEQ ID NO: 30943 - DNA, 201 bp, Homo sapiens
ctgctttttacagtcatgtgctgacaattctaaacattatcaatgataaaatacttctccctcatgatattaactgtgcaatttttgctgcccctgctacrtacatgctttattgcttggaaacaggattacttggtgaaataatgtgaatctttcaattctcatgatacatgttttcaacttaatatccagggtgcagga

SEQ ID NO: 30944 - DNA, 201 bp, Homo sapiens
tctgctttttacagtcatgtgctgacaattctaaacattatcaatgataaaatacttctccctcatgatattaactgtgcaatttttgctgcccctgctayatacatgctttattgcttggaaacaggattacttggtgaaataatgtgaatctttcaattctcatgatacatgttttcaacttaatatccagggtgcagg

SEQ ID NO: 30945 - DNA, 201 bp, Homo sapiens
ctggctaaaacttgatctgctttttacagtcatgtgctgacaattctaaacattatcaatgataaaatacttctccctcatgatattaactgtgcaatttytgctgcccctgctacatacatgctttattgcttggaaacaggattacttggtgaaataatgtgaatctttcaattctcatgatacatgttttcaacttaa

SEQ ID NO: 30946 - DNA, 201 bp, Homo sapiens
ttttaagatgtgggacttaatcacatttgcgaagaccctttttccaaataaggtcgcattcacagatccctaccattcaactcactatggaagcaatgggrtgggaggtaccattcaactcacagattcctaccattcaacccactataaagcagtggcatatgaaaaggatgggaggttgctatgggaatggtctgcccc

SEQ ID NO: 30947 - DNA, 201 bp, Homo sapiens
gatctcattttaagatgtgggacttaatcacatttgcgaagaccctttttccaaataaggtcgcattcacagatccctaccattcaactcactatggaagsaatgggatgggaggtaccattcaactcacagattcctaccattcaacccactataaagcagtggcatatgaaaaggatgggaggttgctatgggaatggt

SEQ ID NO: 30948 - DNA, 201 bp, Homo sapiens
tccttctccccttctgttttgtaaggataggcctgtcattggatttaaggcccaccttaatccaagatgatctcattttaagatgtgggacttaatcacayttgcgaagaccctttttccaaataaggtcgcattcacagatccctaccattcaactcactatggaagcaatgggatgggaggtaccattcaactcacaga

SEQ ID NO: 30949 - DNA, 201 bp, Homo sapiens
gggtgttccttctccccttctgttttgtaaggataggcctgtcattggatttaaggcccaccttaatccaagatgatctcattttaagatgtgggacttamtcacatttgcgaagaccctttttccaaataaggtcgcattcacagatccctaccattcaactcactatggaagcaatgggatgggaggtaccattcaact

SEQ ID NO: 30950 - DNA, 201 bp, Homo sapiens
ggcttttatcttagtcagtctaatctctgcctctgtctttccatctccttctctgtgggtgttccttctccccttctgttttgtaaggataggcctgtcaytggatttaaggcccaccttaatccaagatgatctcattttaagatgtgggacttaatcacatttgcgaagaccctttttccaaataaggtcgcattcaca

SEQ ID NO: 30951 - DNA, 201 bp, Homo sapiens
aacatctgaaatcaagtggtttgcagcgttggctccttctggaggctggaaggagcatctgttccatgcctttctcctagcttcccatgactgccagccayccttggaatttcttggcttttatcttagtcagtctaatctctgcctctgtctttccatctccttctctgtgggtgttccttctccccttctgttttgtaa

SEQ ID NO: 30952 - DNA, 201 bp, Homo sapiens
aaacatctgaaatcaagtggtttgcagcgttggctccttctggaggctggaaggagcatctgttccatgcctttctcctagcttcccatgactgccagccrcccttggaatttcttggcttttatcttagtcagtctaatctctgcctctgtctttccatctccttctctgtgggtgttccttctccccttctgttttgta

SEQ ID NO: 30953 - DNA, 201 bp, Homo sapiens
gaaacacataaataatcataagatgccagataaactgtattggttttaaattagagacgtgccgaccatgtctccctctgaacagcagcctattatttttrattatggcttgcaaagcaaagtgatttcttgccctctttatagcatccctgacagtattctgtcagtttggatgatatgatgcctcatcactgcacacgt

SEQ ID NO: 30954 - DNA, 201 bp, Homo sapiens
gcaacaatggcattctgaatcaatgggactgcagaatttcttagcaaaaataccattccagtaatgcaagagtgcaacgtggtatcattacagtaggtcakagtggcaaaatattttatcaggttaggaagaattctgctttttgctttcccaaacggactgctttggtctttcctcacgcttggcagaacagtgaaaggc

SEQ ID NO: 30955 - DNA, 201 bp, Homo sapiens
cttgtatgggatgtcggtgctttgaaaaaattctatcatcaaagagtaggtttcttagttctgcaaatctggcacctggagatggcattttgaatcggacracctttttagtaagggtcacttgctgttggatcatcgaagggggtgctgagtcttcatttttgttcatccaaatggatatcatttcaatttagctccatg

SEQ ID NO: 30956 - DNA, 201 bp, Homo sapiens
catgtgctctgtgtgctggaagctcctggaggccccagggttatctctgctcacttaggtttgtgatgttgggcaaaaggagaaaatgctgagtctattcrgacccaacttccattaatgcctgagaaataatttaaatcgcaagatttccaatcccataagcagccctagcctctcttctcctgatactccacataccca

SEQ ID NO: 30957 - DNA, 201 bp, Homo sapiens
catctgcgtggtctctgtggataaagtaagcgtttcattcaacttttaaaaatattgcaaattgaccctcgcacatcttttcttactgccggtcacctagycagcaaagaccccaggtgagatcccactggtttggaggaaggagaggaaagtccccacttgggcaaaaacaatttaggatacctgaagattgcaaagccc

SEQ ID NO: 30958 - DNA, 201 bp, Homo sapiens
tgtgtgctcacccaaaagtagtggagcctcaagctcagggagatgtgactggaaaatccactgaataaatgtctatttaaaaaaatcatagcgtctagggsatatacacttctaagcccattcttcaatggagaattacttatgcgcataagtagtttaaacaaaattagtggaaaaacagggagtttaagggagcaagag

SEQ ID NO: 30959 - DNA, 201 bp, Homo sapiens
acaagtaatactagtaatcatctcactcctgtaaacagtacagttgccatacctcaagtatctagtatacttgggacattagtctgggaatttttctccartcctcacgctagcatttctagtaatgaggaaactgggggtcagggaagcttagtccacatttctcaccttttctccttttctcccatcccccagccagtt

SEQ ID NO: 30960 - DNA, 201 bp, Homo sapiens
tttaactctgtattccaatctaattacatgtctatttccaagtaacgtcacattctgaggcaatggcggttgggacttgaacatatattcttcgggacatkattcaacctataacaagtaatactagtaatcatctcactcctgtaaacagtacagttgccatacctcaagtatctagtatacttgggacattagtctggg

SEQ ID NO: 30961 - DNA, 201 bp, Homo sapiens
caatcccactgcaggtttaggctgcatgtttcatccatttgcagctgtagcattttacaaaccacagcataaaccctaggaataattctgttccccactgkgatagagcattgttattaatataattttacaaacatcattcgtttgaaagctttatccagcctcaccacagctcattagtgaaccttctgacaatcccgg

SEQ ID NO: 30962 - DNA, 201 bp, Homo sapiens
atggctctttttccttcttttgacatacttggagttctagaagtggaattactgggtcggaggtcacaaatggagaggtcttttaaatctcagcctgcaarcaatcccactgcaggtttaggctgcatgtttcatccatttgcagctgtagcattttacaaaccacagcataaaccctaggaataattctgttccccactg

SEQ ID NO: 30963 - DNA, 201 bp, Homo sapiens
ttctgcatggctctttttccttcttttgacatacttggagttctagaagtggaattactgggtcggaggtcacaaatggagaggtcttttaaatctcagcstgcaaacaatcccactgcaggtttaggctgcatgtttcatccatttgcagctgtagcattttacaaaccacagcataaaccctaggaataattctgttcc

SEQ ID NO: 30964 - DNA, 201 bp, Homo sapiens
gatcctttcagagttactcatacgacttacacattcccatgggagctccaactctgtttggtcccaatgtgccctttttgtctcactccttcctcccacayatcctgctccccactcccctaattactcatgattgcactaacagccacatcctttcacacctctgagcttttggtcatgctgtaatctctacctgagttc

SEQ ID NO: 30965 - DNA, 201 bp, Homo sapiens
gattagcttgaccaacatagtgaaaccccgtctctactaaaaatacaaaaattagccaggcgtggtggcgcatgcctataatcccagctactctgggcctraggcaggaaaatcacttgaacctgggagacagaggtttcagtgagccgagatcgcaccattgcactccagcctgggcaacaagagtgaaactccatctca

SEQ ID NO: 30966 - DNA, 201 bp, Homo sapiens
gaacaaatataattatcatatacaccctttccattattagctctctccatttttaatgaaaacagtggttggtggtttataagaagttttttgtcggtgtsatctttcacatcagtttgctacccagaatttaaacattccttttttgctgctgttttaatttgaaataagaatggtagcccccaggtcccctaacagtgg

SEQ ID NO: 30967 - DNA, 201 bp, Homo sapiens
aaattcaggccacaatgacttcaaaaacccttgtatccttgttttgtttcgtttccctgcaaacattgttttagttgagatgaaattcacgtaatatacarttaaccattttaaagtgtacacttcagtggcatttagtgaactcagtgttatgccaccgtcacctctttttagtttcaaaactttgtcatcaccccagaa

SEQ ID NO: 30968 - DNA, 201 bp, Homo sapiens
cctgccttgcaagtttggagttaaggccacgcagaccagagttacgtgcacaggttgtaatactctctcttgtccctggttgcctgattcaagttaggggyttcttctggattccgtaggtaggatgctgactctcagctgtcctgatgccactggtgttcctctagtaggcaacattgatggtaaacatagaaagtcatg

SEQ ID NO: 30969 - DNA, 201 bp, Homo sapiens
cggaagtctgcctctgtgacagattctggggctctaaggaggaatttacttcttcaaagtacagtttcctgccttgcaagtttggagttaaggccacgcasaccagagttacgtgcacaggttgtaatactctctcttgtccctggttgcctgattcaagttaggggcttcttctggattccgtaggtaggatgctgactc

SEQ ID NO: 30970 - DNA, 201 bp, Homo sapiens
tcctcaggtagccactggtgtgtggggtcataccaagtcatttggtttacatcgggaatgccttttgtcgttatgtctagacccctggagaacagcccacrgcaatgcacttgtggaaattcggactgtggattacactgagtaacaatcctaataatacctgcacacaatcagttgcctgtccaaaaagcaataaagaac

SEQ ID NO: 30971 - DNA, 201 bp, Homo sapiens
gtgggtacttacttagggaactgtggaggtgtcctcaggtagccactggtgtgtggggtcataccaagtcatttggtttacatcgggaatgccttttgtcrttatgtctagacccctggagaacagcccacggcaatgcacttgtggaaattcggactgtggattacactgagtaacaatcctaataatacctgcacacaa

SEQ ID NO: 30972 - DNA, 201 bp, Homo sapiens
ctgacttcctttctccagctgtgagactcccctgtacaatttttctggagggtctagagtcacatgagtcacgccaagccgccctttcagtgcgaaggaakccaagcagagccctcctctgctgtgggtacttacttagggaactgtggaggtgtcctcaggtagccactggtgtgtggggtcataccaagtcatttggtt

SEQ ID NO: 30973 - DNA, 201 bp, Homo sapiens
agtcctacctgacttcctttctccagctgtgagactcccctgtacaatttttctggagggtctagagtcacatgagtcacgccaagccgccctttcagtgygaaggaatccaagcagagccctcctctgctgtgggtacttacttagggaactgtggaggtgtcctcaggtagccactggtgtgtggggtcataccaagtc

SEQ ID NO: 30974 - DNA, 201 bp, Homo sapiens
gagatagaacggagtacccagttgcactgagggaagagcagggatagaagtgggctccgggtctaggagacggtggaaagagaggactgctcctagcgtgwgagtgtcagggaagcttgctgggggaaatacaaggaaggaagagaatgcaggcagctcaaaagagccgggcaaggagacctgcagagcgagcggaggcct

SEQ ID NO: 30975 - DNA, 201 bp, Homo sapiens
aaattcccctcctgctttccatatgttatatagttaactgtaaaagtggcaccacctcttaaacagccagctattctgatcatttgaaatctggaacattstttcctacggtggttgacttttcactgcctttgaggttctttccaagtaaaggcgttattctttgtggtgtgctcctggaggtcactaacaaaacgtctc

SEQ ID NO: 30976 - DNA, 201 bp, Homo sapiens
tctgctcagtctacctttagcagaagattaaaaatgaaaactcttcttgttagaggtagaagagatcctttcccaaaccatagattcatggaactgtcaamgagcagcactgaactttgtactcaatgccttaatttttccagttgaggataattcacactaaacaagggatttcacctctctgactcatgcatcaggaac

SEQ ID NO: 30977 - DNA, 201 bp, Homo sapiens
ttctggtcaaatacgttcttctctgattaggcctctcattttaaggcagttgagaagactcacagatgtgattcactggcaatggctctggttcaccaagsttagctctgctcagtctacctttagcagaagattaaaaatgaaaactcttcttgttagaggtagaagagatcctttcccaaaccatagattcatggaact

SEQ ID NO: 30978 - DNA, 201 bp, Homo sapiens
cagatgccgatgaccagtaagaccacatctgtgggcacaaaagagcccatttatgttttttatgggaacctaagaaggaaatgcttttctggtcaaatackttcttctctgattaggcctctcattttaaggcagttgagaagactcacagatgtgattcactggcaatggctctggttcaccaagcttagctctgctcag

SEQ ID NO: 30979 - DNA, 201 bp, Homo sapiens
tctcagatgccgatgaccagtaagaccacatctgtgggcacaaaagagcccatttatgttttttatgggaacctaagaaggaaatgcttttctggtcaaakacgttcttctctgattaggcctctcattttaaggcagttgagaagactcacagatgtgattcactggcaatggctctggttcaccaagcttagctctgct

SEQ ID NO: 30980 - DNA, 201 bp, Homo sapiens
tgggcagcgtagtagaagggtcttgagatttggagtcgtaacgagttttcaaaactcataactatattacagtttgcgcaagtcatttaacctatctgaascttcatttcctctcccacacaggataaaataaggataataacagccattttagagttcgtattaatatttaagtgggagaatgcagccagtaccctgaga

SEQ ID NO: 30981 - DNA, 201 bp, Homo sapiens
taaacttctgtaattataatcctagagaagctaaaatattcagtaaaaattactagcaatgaaataatttgaagagttggctagatgtaaggtaaatatayacaaattagctggtatatactagttataatttaagatggagatagaaaaaaaccccattcaaaatattaacacaactatcagatatttaagaataaatgt

SEQ ID NO: 30982 - DNA, 201 bp, Homo sapiens
cttcttggtgttgtgataagcccgtctagcacggagggccagaaggaagcagtgtccattaggatgactctccattgcttcttggtgttgtgataagcccrtctagcacggagggccagaaggaagcagtgtccattaggatgactcttcagtgcttcttggcgttgtgattagcccgtctaacagggcgggccagaagga

SEQ ID NO: 30983 - DNA, 201 bp, Homo sapiens
cctcaaccttggcaaaataaactttctaaattagctgagacctggctcagattttcagggttcacagacctgtcaacatgaactgtcagtggtgatagcamccgttttcaagtctcattttaatcggaaggaagttttaccagctctttggctttgtagaaggtcgagttctccaaatttaagagattcaaaaatgtcctc

SEQ ID NO: 30984 - DNA, 201 bp, Homo sapiens
agtctattggatgcggtggtgtggccgatttcttggacttgctacattcttaggcaagtgacatctcccttcatttgtacagagggagttagaattgaatygaacttccaccgcagcatccgccagctcttataatcacttgccctttgctgatggtgagtttttagctgctttctctcctaccatacagcactgacacct

SEQ ID NO: 30985 - DNA, 201 bp, Homo sapiens
tctgaactgcctttccatattctcggtccagctttctataagattgctctcatttactggtgagagctctgtgtaaattaaggaaaccatcaccaccttcraatggctgactattgtaaatattttaatgtttgtcgtttgtttgcaaccttgtaattttttcctgtgcagcaattttaactttctatattcaaatatact

SEQ ID NO: 30986 - DNA, 201 bp, Homo sapiens
agggagcagtgatggagcacaggctggaaaactgagttgaggggtcagtggtggaccctgaaggttagactaagaaatttagactccagcctacataaatktagactccatgcagaatgactggatgtcctataggacatgcaaagccacagggaattttggaacaggaaattgtgctcaaagctgaattttgaggaggta

SEQ ID NO: 30987 - DNA, 201 bp, Homo sapiens
ggctctgtgtcccaactcaaatgtcatctcgaattgtaatccccacgtgtcaaaggagggaccaggtggaggtaatttgatcatgggggtggttttccccmtgctgttctcatgctagtgagtgagttgtcatgagatctgatggctttgtaagtgtttggtagttcgttctgtgttcattctccctcctgccgccttgtg

SEQ ID NO: 30988 - DNA, 201 bp, Homo sapiens
aagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgaggg

SEQ ID NO: 30989 - DNA, 201 bp, Homo sapiens
aactcaaaacaagccagtaattcagaaaaagcccagttcttctcacaaagaaagatctaagtgtgatatgagagtatatgcatggagaatattttctgagstggtgatgagctgcagggggcctctcccagcccccgcactggttgcacttttaaataagagaaaaaaacagtgataggactgacctgcgtgtagaagttt

SEQ ID NO: 30990 - DNA, 201 bp, Homo sapiens
tgggagaaaccatcagttatgcagtttacaatatctctaaactcaaaacaagccagtaattcagaaaaagcccagttcttctcacaaagaaagatctaagwgtgatatgagagtatatgcatggagaatattttctgagctggtgatgagctgcagggggcctctcccagcccccgcactggttgcacttttaaataagag

SEQ ID NO: 30991 - DNA, 201 bp, Homo sapiens
agatgttgttgttcatgtttcccagcccattggtgatgacacagaggcaggagccggggctgcagactaaattatatacatctcaagggcagttagacaaytagctcgcccacaggaacattgcaataagcacagtatctgctttcccagcaaagccaagtgcaagttcctgcctgctctgatgacctcttgtgcctccag

SEQ ID NO: 30992 - DNA, 201 bp, Homo sapiens
ttgcaatattagggacatgctaatacaattattcattgtatatgttaattcaaattaaatggaatgtcctatattttatagggcaaacttaggcttacgcytgggtggaatgagcaatccctgtcgccaaagaaggtccccagcatagcagttggctggagaaggaagggctgaccataagttgcactaaactgctctcag

SEQ ID NO: 30993 - DNA, 201 bp, Homo sapiens
attttggtctgtaaggacattaataatgttttggtaaaacctcagttatcatctgctattactgttatttcataagacacatcattttccttcaaaattamaatgaaaactcataagcatacatcaaagttgaaagaattttacagcgaaccaccattaacattttgctataatggctttatcatatatccattcatccgt

SEQ ID NO: 30994 - DNA, 201 bp, Homo sapiens
taacattgaaaaaaaatgtggtaacatagggttgcctgtgtcttattttggtctgtaaggacattaataatgttttggtaaaacctcagttatcatctgcyattactgttatttcataagacacatcattttccttcaaaattacaatgaaaactcataagcatacatcaaagttgaaagaattttacagcgaaccaccat

SEQ ID NO: 30995 - DNA, 201 bp, Homo sapiens
atttgtatgttgcacccaacggggttttctccataggggttaggcgtaacgtctttggtaaacttggcacctgtagaaaggtcttgtggtgggcagggggstgtgaatgggggaatgagaactagggaacccaggacccaggacccaggacgagagttcagcaaagaccatttacagaagctatccttccaaaacggccac

SEQ ID NO: 30996 - DNA, 201 bp, Homo sapiens
tgactcccagtgggtggtattttctcctagagtgcatttctgcttcttaaccagcagaagaaagcccattaactaacccctcaggggtcaccatgggcaamggagtgcatattaagaactgtctggaaagaaaagaaggtcattggaatcttcttcaccccttccctggtactgatggttgcatttcaatggatttctcca

SEQ ID NO: 30997 - DNA, 201 bp, Homo sapiens
acaggcaaaatgataagtcaggtcctgccgggtgactaaggcagtgtggcaatgcttcaagcctttaaaaccatatcccagtggccccaaagcattaataygtctggaacattgcctgtccaatatctagagaggcgcctgcagaatttgattcctaggtacatcaagtttttgagctggaagaaacttgagacgctcttt

SEQ ID NO: 30998 - DNA, 201 bp, Homo sapiens
cacatctgaacttcaggtgaagtttcaaaccaccaggcaacatgcattacaggcaaaatgataagtcaggtcctgccgggtgactaaggcagtgtggcaaygcttcaagcctttaaaaccatatcccagtggccccaaagcattaatatgtctggaacattgcctgtccaatatctagagaggcgcctgcagaatttgatt

SEQ ID NO: 30999 - DNA, 201 bp, Homo sapiens
ctgagagtgggaactgaggagattcaagccttttgcccgtcgatcgcagttcagatctgttgattttgaccattgcatcttgcctcacatctgaacttcargtgaagtttcaaaccaccaggcaacatgcattacaggcaaaatgataagtcaggtcctgccgggtgactaaggcagtgtggcaatgcttcaagcctttaa

SEQ ID NO: 31000 - DNA, 201 bp, Homo sapiens
gaaggcgatcatgttggcacagggcataagagagtagcggggctgagagtgggaactgaggagattcaagccttttgcccgtcgatcgcagttcagatctrttgattttgaccattgcatcttgcctcacatctgaacttcaggtgaagtttcaaaccaccaggcaacatgcattacaggcaaaatgataagtcaggtcct

SEQ ID NO: 31001 - DNA, 201 bp, Homo sapiens
cgcagcgctatcatatgctccacatgctttctaatgtcttttgtttgtattaggaaaaaacataaccctctcctactgagaaccagagagagcccctcagrttctgagaatgacgacattcaacatcgtactccaaagggggttaggtttgtgtgctaggggtgaacgctgtgcaatttaattctgtttccaaaagatctt

SEQ ID NO: 31002 - DNA, 201 bp, Homo sapiens
atcctgcgtcctctcccttcccccattggctctgttcttcctgccagtgctcttccccctgctcactgggttccagctgtgcgggcctccctgctgttcawtggaatgagacccatgcccctcctggttatcccactcagagtgcccttcaacagctacagggctggcccatcctttctctgttaccttcggaggaagcct

SEQ ID NO: 31003 - DNA, 201 bp, Homo sapiens
cgggggagctgacattgcataaataataaaacaaatggagccacatttagttatcactcatctagcggaagtcgatcttcttgggacatgagtaggctctmacctggcaggtttttcaacatggaaccattatttgtcacatgtgttctgtgtgccagggactgagttcttctcaacggagtttacatgtgagaggagcaa

SEQ ID NO: 31004 - DNA, 201 bp, Homo sapiens
cagcctagacttggatccctaagcacagcctgtggatgggacgttttaaggtaaagggaggacgcagagcattgcagcccgttggttgttttctccagcayagccatgcaaaatccatgtagcggcaggaattttgcagctggagttgctcccctgagactctgatcagataaagacagggtttgctgaacaccgtaggtc

SEQ ID NO: 31005 - DNA, 201 bp, Homo sapiens
tggagagtggctgagaaaccagggagaaacaggaaggagctgattgaggagaccaaaggagggtggggccgcagctctcaggcactcttggtgttcagaargccagcttgaagaaagatgtgcatatttgcaaatgcatttcttgttcctagtgaagaggtgaggaaggacactgactgtgctagagctgtacaaagagaa

SEQ ID NO: 31006 - DNA, 201 bp, Homo sapiens
ctgtgggggctgttttggttaaccactcgcatcagttttaagtctccacaggcagaaccagaccatcgtgaacttcttgatttacatggtggtggagagtrgctgagaaaccagggagaaacaggaaggagctgattgaggagaccaaaggagggtggggccgcagctctcaggcactcttggtgttcagaaggccagctt

SEQ ID NO: 31007 - DNA, 201 bp, Homo sapiens
agacagttaggttcgaaggaaaacaaagacaattgcacggcacagagggaatatactgctacggtaaaccgatcactaacacccggccctgaatttgcttmaaagttttcactaaggcacaaagggagccgtgtggagctccggagttcccatctgaggtcttgtctaactccttggcaacttttatgtatttgtatagga

SEQ ID NO: 31008 - DNA, 201 bp, Homo sapiens
caaaatgcattacaggctctaatgcacgataagacagttaggttcgaaggaaaacaaagacaattgcacggcacagagggaatatactgctacggtaaacygatcactaacacccggccctgaatttgcttcaaagttttcactaaggcacaaagggagccgtgtggagctccggagttcccatctgaggtcttgtctaac

SEQ ID NO: 31009 - DNA, 201 bp, Homo sapiens
catccttccaaaatgcattacaggctctaatgcacgataagacagttaggttcgaaggaaaacaaagacaattgcacggcacagagggaatatactgctayggtaaaccgatcactaacacccggccctgaatttgcttcaaagttttcactaaggcacaaagggagccgtgtggagctccggagttcccatctgaggtct

SEQ ID NO: 31010 - DNA, 201 bp, Homo sapiens
aaaacctcacaccagtgttgttttattcatctgcttatgcacgcgtatggctgcaacatccttccaaaatgcattacaggctctaatgcacgataagacarttaggttcgaaggaaaacaaagacaattgcacggcacagagggaatatactgctacggtaaaccgatcactaacacccggccctgaatttgcttcaaagt

SEQ ID NO: 31011 - DNA, 201 bp, Homo sapiens
cttccctgttggccattactaatgtcaagaacaaagctgtgtaaagtcactaagattttggaggtatcggctgttgcagtagaacctagcctatctcaccygacacaaacgttttctttctcacaaaacctcacaccagtgttgttttattcatctgcttatgcacgcgtatggctgcaacatccttccaaaatgcattac

SEQ ID NO: 31012 - DNA, 201 bp, Homo sapiens
gtcaacagagcttccctgttggccattactaatgtcaagaacaaagctgtgtaaagtcactaagattttggaggtatcggctgttgcagtagaacctagcytatctcacctgacacaaacgttttctttctcacaaaacctcacaccagtgttgttttattcatctgcttatgcacgcgtatggctgcaacatccttccaa

SEQ ID NO: 31013 - DNA, 201 bp, Homo sapiens
atgccccagcaattaaggaagcaatgttcagatgaaacccatgtcttcctcctgggtccctgagtgaccacagtcaacagagcttccctgttggccattastaatgtcaagaacaaagctgtgtaaagtcactaagattttggaggtatcggctgttgcagtagaacctagcctatctcacctgacacaaacgttttcttt

SEQ ID NO: 31014 - DNA, 201 bp, Homo sapiens
tggttcaccctgaccccttcctatgccccagcaattaaggaagcaatgttcagatgaaacccatgtcttcctcctgggtccctgagtgaccacagtcaacrgagcttccctgttggccattactaatgtcaagaacaaagctgtgtaaagtcactaagattttggaggtatcggctgttgcagtagaacctagcctatctc

SEQ ID NO: 31015 - DNA, 201 bp, Homo sapiens
gaaatattaagagccagtgtgtggttcaccctgaccccttcctatgccccagcaattaaggaagcaatgttcagatgaaacccatgtcttcctcctgggtycctgagtgaccacagtcaacagagcttccctgttggccattactaatgtcaagaacaaagctgtgtaaagtcactaagattttggaggtatcggctgttg

SEQ ID NO: 31016 - DNA, 201 bp, Homo sapiens
cccctacttgagggcgcaggtaggggcactttgctgcctcctttgacaataagcattgccattgccatgtgatttgctttgcctaatgaaatgtgagtgayacttccagatggaaatattaagagccagtgtgtggttcaccctgaccccttcctatgccccagcaattaaggaagcaatgttcagatgaaacccatgtct

SEQ ID NO: 31017 - DNA, 201 bp, Homo sapiens
aatgtggaaatctacatcagagagtggtgtgagtggttcccaaaatgcctacctggcactcctaccaaagacacagcagagaacttggggcctcttgtttyagccattttcatcttcactgtaaatctagacaagataatgaatgaagaacctgacacatttaaggaactccatagttgggagcccagtgtgagtcattat

SEQ ID NO: 31018 - DNA, 201 bp, Homo sapiens
agcccaaaggaactgtgtgcctcgcatcttggtccatcttcatgggttgatcattgtggttcatatcactgtttcatgaaacacagcccgccagaaagtcscgagtgttttgatttcatcctatacctatagttacaggccatttaagatccacagtctgctcttttagcttctgccagcacatttggacatctgtgcagt

SEQ ID NO: 31019 - DNA, 201 bp, Homo sapiens
tgcacgtcgcagaagatcaggaatttgcacattatagtcacaaccatacctagaaccaaattgcctaacactgaatcccaaatccaaattcctgggagatmgaattcaattcttctcttgccacaaatcagctgtttatactcctctttgcacgttgcagaagatcaggaatttgcacattatagccacaaccatacccag

SEQ ID NO: 31020 - DNA, 201 bp, Homo sapiens
tcatggattattggttgtgagtaataggaacctttcaatctaacttaggaaaaaacgttagggagccaaggaggaagagtgggtgtgatgatgcatcaggrtaccagagaatcccgtggaatcccacagtgacacagccaagccttgggaggggtgacactagcgatagagacagaaacccacacaggagtccttttctct

SEQ ID NO: 31021 - DNA, 201 bp, Homo sapiens
ctaccccaggctttgcaacagggaactatatcattattttgcagacacaacaaattctgcaagcatgtatctttggaataaaggagagagggttggacacraatgtgattacaacatatgcttctctgggcatagctttgccccattgcacgaatatagaaaatttggcaggctgaaaataagcggaaagatcctcaagct

SEQ ID NO: 31022 - DNA, 201 bp, Homo sapiens
acaacataattgtttgtgtctaccccaggctttgcaacagggaactatatcattattttgcagacacaacaaattctgcaagcatgtatctttggaataarggagagagggttggacacaaatgtgattacaacatatgcttctctgggcatagctttgccccattgcacgaatatagaaaatttggcaggctgaaaataa

SEQ ID NO: 31023 - DNA, 201 bp, Homo sapiens
ccttcactcatcttacctccttcttctgtggcatttcataaatttaatgattgtaattgtgattacaacataattgtttgtgtctaccccaggctttgcawcagggaactatatcattattttgcagacacaacaaattctgcaagcatgtatctttggaataaaggagagagggttggacacaaatgtgattacaacata

SEQ ID NO: 31024 - DNA, 201 bp, Homo sapiens
ctttgacctgtcattcactaagtctttcaccatccttcactcatcttacctccttcttctgtggcatttcataaatttaatgattgtaattgtgattacarcataattgtttgtgtctaccccaggctttgcaacagggaactatatcattattttgcagacacaacaaattctgcaagcatgtatctttggaataaagga

SEQ ID NO: 31025 - DNA, 201 bp, Homo sapiens
aggttgtttgccccaaccccctgttacattcttgaaccatatgtttcccattgtttgcacttcccctagtcacctggtgctttaatttttgcctgtaaccwtctgaaactttccttaaatgttcggctttgacctgtcattcactaagtctttcaccatccttcactcatcttacctccttcttctgtggcatttcataaa

SEQ ID NO: 31026 - DNA, 201 bp, Homo sapiens
taccatatccaatttttgcctctctttttttcttgggttccccccgacaaaaaaaaatatgacagaagtatcacccatccagccagccagccatcaatccrgtatccattcatccatccatccatctaggcatcccaggtgactcattcctgtgaccttgggagacagtctttcttcctagaggttgtttgccccaacccc

SEQ ID NO: 31027 - DNA, 201 bp, Homo sapiens
tagcccataagtgactcacgtcacttctgactaccatatccaatttttgcctctctttttttcttgggttccccccgacaaaaaaaaatatgacagaagtrtcacccatccagccagccagccatcaatccggtatccattcatccatccatccatctaggcatcccaggtgactcattcctgtgaccttgggagacagtc

SEQ ID NO: 31028 - DNA, 201 bp, Homo sapiens
gacagtgggtatttaatcaccttagcccataagtgactcacgtcacttctgactaccatatccaatttttgcctctctttttttcttgggttccccccgamaaaaaaaaatatgacagaagtatcacccatccagccagccagccatcaatccggtatccattcatccatccatccatctaggcatcccaggtgactcatt

SEQ ID NO: 31029 - DNA, 201 bp, Homo sapiens
aagacagtgggtatttaatcaccttagcccataagtgactcacgtcacttctgactaccatatccaatttttgcctctctttttttcttgggttccccccracaaaaaaaaatatgacagaagtatcacccatccagccagccagccatcaatccggtatccattcatccatccatccatctaggcatcccaggtgactca

SEQ ID NO: 31030 - DNA, 201 bp, Homo sapiens
atggtccatttaaagtgcttaaaccaattgccaggcacataataggtgctcaataaatacttcctttatttccctgttaggcctctcccaaccagagatcraagatgattggccctgaagttatttttccccccaaatttgatagaaatcagtagagatgctaaaatataatacatttgacctgcattgatcaaggtaggc

SEQ ID NO: 31031 - DNA, 201 bp, Homo sapiens
ggtgataatgagacctatccctaacggttaaagtgacatggtccatttaaagtgcttaaaccaattgccaggcacataataggtgctcaataaatacttcstttatttccctgttaggcctctcccaaccagagatcaaagatgattggccctgaagttatttttccccccaaatttgatagaaatcagtagagatgctaa

SEQ ID NO: 31032 - DNA, 201 bp, Homo sapiens
gttgtctgtgtttaaaggacttgatggataaagggagatttaacagtttatagccagattggactcaaccatgatgatttctggtccatcttttagaatgkcttcacttctcttggcctttatttctccaagtggtgataatgagacctatccctaacggttaaagtgacatggtccatttaaagtgcttaaaccaattgc

SEQ ID NO: 31033 - DNA, 201 bp, Homo sapiens
gttgagaggagagtcccttgaatgccacgcaacatttctctctgtaggtgtcctctgcacactgtccaaactccatttttaaccttgactgcatagtaccrtgtacattcattaagcatccctcgccataggagaatctgagttcctgggagcatttaacacagttcctggccttgagtaaaaacttcataagcacttgtt

SEQ ID NO: 31034 - DNA, 201 bp, Homo sapiens
ccaaatccttttgttttgttatcatttgctaatagagatctttgaaagaaaattcaaagattgaagtttgtattctcctaaactcctgcaaagaagtcctstgcaaggatcgttcactagtgttctgcatcgttcttcttactcaactctcccgagaggcattgtggacgcctgtggggttggtttttggcacccatccct

SEQ ID NO: 31035 - DNA, 201 bp, Homo sapiens
atggaggcagcatataaggttgcaaagcactgaccttctctttttatgattcccatttattccatagactgtgaagtctgcctgtacatttccaggctagyagtttttaatcaaatgtatgatcactttcttctgatgaacacagttaaggggctttgttgttcaggtgagtctcacattgtactcctctcctaagagcat

SEQ ID NO: 31036 - DNA, 201 bp, Homo sapiens
ggggatgggaggggggctccggaagatccctaacccattgtggacacaccatttatgttagtggaatctggtaagagtgattgaggagagagcattgggtsaatgaccctgtaatccttataaaaatagtagcaacggtaactaatgatgtttatgaactgcctaagaatgccatgactgtgtcaagcacttcccataact

SEQ ID NO: 31037 - DNA, 201 bp, Homo sapiens
acgaagtgttgtaatacaaggcaaagaaaatacaaacccatccttagtcatttagaaagacaacctggttgagaatttaagatgatggtttagggcatagyttgtggaattcgatgggttgcactgtaagtttcagtttccttatctgtaaaagtaggaataatatctagacctaaaggttattttgaagattaaatgaga

SEQ ID NO: 31038 - DNA, 201 bp, Homo sapiens
agagactgtttgccagggaaccaaggcctttcaaagttgaggacacttcccggtgccgtgcggtgtaaatcacagtgcaaactatgcgattatcccctgcwgaggaatcgagtgtgactttatgggattcttcaccaagcacttaggaataatctgatataaaacagcaggggtggagagtaatgacaacttcaaattagt

SEQ ID NO: 31039 - DNA, 201 bp, Homo sapiens
ccattttaaggctgtgtgagcactgatccatgacagtattggttcaggggcaaagaatgggaggaaagaaaaagacaagttatagctgcactgaaaacaarctgggcatgtcctaattttgctcagggctacttctcttagagtcgttaaggttttgagcatattaacagcaatactgatcatagctaatatgcctctatg

SEQ ID NO: 31040 - DNA, 201 bp, Homo sapiens
tgttatttcactgatggaaaaacaagcacagagaggctaaggaatatgctgaagcttgcacagctagtaaatggcagaacattcagactggaattcagacktatacactcacattcataccacacagcctctcgaagggacgtgccccttgaacgcaagagaggtacattgggtggccatggtgctcacagtctctcaatc

SEQ ID NO: 31041 - DNA, 201 bp, Homo sapiens
tatagttatgcaaatgaaaaccattaatcctggagcctctgacttgcaaggtgtgcttcagaaatttgcagcttctatttaggtaggaagagtttgccagyccgaaaactccagtaagcaaacagctttatagtaccccagccatagaaagtgagagctttcgaagaatctgtggttagaactaagaggatttttctttct

SEQ ID NO: 31042 - DNA, 201 bp, Homo sapiens
aaactttatttacaaaaacaagaggagggccagattttgcctttgtcaaggaagtaagcataatagtgcaagcagcacgtgcccgctctttcacactgggrcaaacacaggggatttattcggcacaattgagtaatgtggatgaggctgctcagggctggcagttgtaggacgcaaaaccttgaggggcatcgatattct

SEQ ID NO: 31043 - DNA, 201 bp, Homo sapiens
tgagtcccccatcctcccctgtgtagaatgaggctaatgctagtgctcatttcatagagttgctacaataatcaatgagataatgtgcataaagatttacrtacataataactgctcaataaagggtagatgttaaaattagcatcagcgagctctagaagatgctaagttctctggaaagatcagctctgctcctgtcaa

SEQ ID NO: 31044 - DNA, 201 bp, Homo sapiens
cttggaacatggaagttcattgactttgttgcctagcagggcctggagctgggtttcttgcctgatcaatgtatatcattttgccaagagacagagtctgygctggagagattgattccctggttatttatcttcctctgcccagtgtaaattggtcagcctgatcctattcgcatgataaaaatcataatgtctcaaatt

SEQ ID NO: 31045 - DNA, 201 bp, Homo sapiens
ttgctcctgggttgcaggacgcatccatggatggagcatgggttttgggctgtggggggacaatgaggtggttcctgaaatccctagttactagcagacargtgcatcagacaagtgcatttcaccgttctgagcttcagtctcttatccaagcagaaacatggccagaatgcaatgtcctaatacatgtaattcattacg

SEQ ID NO: 31046 - DNA, 201 bp, Homo sapiens
aaaacagtccatcttgttggaaggctgtcaagctgtgtaataaaagaattactgttctccctttgcatttatgcattgcatgtctctgttgaattcagagygctttatagacctctgatcagcttccagcatcctcttggtatgagttctagggggagatgaggaatgtgcctaattcccttgagtgatttacttggtgtt

SEQ ID NO: 31047 - DNA, 201 bp, Homo sapiens
ttaggatgtcagtcccagttttaattacaagtgttcctggttgtggcattcatgtaattgggggctgatttatgccaaatgatatgcactgatgtaagggsctggagcccaagagggaggggaggccaagaagaggcagtggccccccaccaagcccggaactgaggtggcacatgtcagcggctttgctcagaagcaccc

SEQ ID NO: 31048 - DNA, 201 bp, Homo sapiens
acaccagcaactgtatcacccagttcactgagagttaaaatcacccatgtgacgttctctctgcaggcacatagtaagtgctggataaatgatagggattsatattgaccagctttgacacatgaataggagagggttaggcaaagacaaagagagatggggatgccaagtaccctctgggcagaggaaaccatgagtgca

SEQ ID NO: 31049 - DNA, 201 bp, Homo sapiens
gttttctggagccaggatgagctgggaccaacaccagcaactgtatcacccagttcactgagagttaaaatcacccatgtgacgttctctctgcaggcacmtagtaagtgctggataaatgatagggattgatattgaccagctttgacacatgaataggagagggttaggcaaagacaaagagagatggggatgccaagt

SEQ ID NO: 31050 - DNA, 201 bp, Homo sapiens
ttcctttgtttgcaaaatagtaacaatattttccttccaagtgatggtgaggatttaagagttaacctgagtgtctgctgcatagtaggtgctcaataaastataacgtctttatttcttttccttccaatgagaagtcacttcctggagggaagccacctccaggaacagtcctggttcaactcatgaggagggtcactg

SEQ ID NO: 31051 - DNA, 201 bp, Homo sapiens
ggctggcttccccaggaggctttcacaaatgcttaccgagcatctgctgtgtgccagacaagagtgaggagctggggactcagagaggagcagacgagggrgacactcacattagagagtggcgtgtgctgagggaaggtgcctcaggcgacagatgggaccagggcctttaactcagtggcagcttcagagacagatctg

SEQ ID NO: 31052 - DNA, 201 bp, Homo sapiens
tactcatgcctagacttcttgctttttaaaaataatccacccatgaaacaagtgtttatttacaaggctggcttccccaggaggctttcacaaatgcttaycgagcatctgctgtgtgccagacaagagtgaggagctggggactcagagaggagcagacgagggagacactcacattagagagtggcgtgtgctgaggga

SEQ ID NO: 31053 - DNA, 201 bp, Homo sapiens
aagcgattctcctgcctcagcccataggcacatgccaccacacctgactaatgtttgtatttttggtaaagacaaggtttccccatgttggccagccttgycttgaactcctgacctcaggtgatccacccacctcagcttcccaaagtgctgggattacaggtgtgagccaccgctcctggcacccatcaaattttcaaa

SEQ ID NO: 31054 - DNA, 201 bp, Homo sapiens
tcctgggttcaagcgattctcctgcctcagcccataggcacatgccaccacacctgactaatgtttgtatttttggtaaagacaaggtttccccatgttgkccagccttgtcttgaactcctgacctcaggtgatccacccacctcagcttcccaaagtgctgggattacaggtgtgagccaccgctcctggcacccatca

SEQ ID NO: 31055 - DNA, 201 bp, Homo sapiens
gctgtttgttggtttcagcaaacaaagggagatcacagcacctgtcccaggccttgtcttccagccccacaaacgtgcacctgcagccggagaccaggggrccccgatcaggtggcagggcctttaattggagccacgtgtgtataatgagcagcgcacacacacaaaggcgagctaaaaatgtctccacccttctaaata

SEQ ID NO: 31056 - DNA, 201 bp, Homo sapiens
cttgctgtttgttggtttcagcaaacaaagggagatcacagcacctgtcccaggccttgtcttccagccccacaaacgtgcacctgcagccggagaccagkgggccccgatcaggtggcagggcctttaattggagccacgtgtgtataatgagcagcgcacacacacaaaggcgagctaaaaatgtctccacccttctaa

SEQ ID NO: 31057 - DNA, 201 bp, Homo sapiens
agtctgtgaaatccccatttcacagatgttgaaactgagacttagaagcattatgcaccatgccaaaggccatggaaggacagagcttgggcatgctcccracaccaggtcatactgatgtcactctccctactcccttcactccctccagcacctggccttcacctgaaggtgctgaccttgctgtttgttggtttcagc

SEQ ID NO: 31058 - DNA, 201 bp, Homo sapiens
ctgcgttcaggcctccatgacatctgcgaaattcctccccctttgcttggtagcctaactcactcaggggggcaaattatcccatcatattcacagttgcygcccacactcaagagaggggattctataggaaatggaagtcttgggggccatcttgaatcctgactaccatagtctgtgaaatccccatttcacagatgt

SEQ ID NO: 31059 - DNA, 201 bp, Homo sapiens
aaccaactgcgttcaggcctccatgacatctgcgaaattcctccccctttgcttggtagcctaactcactcaggggggcaaattatcccatcatattcacmgttgccgcccacactcaagagaggggattctataggaaatggaagtcttgggggccatcttgaatcctgactaccatagtctgtgaaatccccatttcac

SEQ ID NO: 31060 - DNA, 201 bp, Homo sapiens
gactcagggtccctttcctccatcttcaaagccaacagcacctggctgagtctttctcatgctggcatccttctggctctctcttcagattccctcttccrctttaaggacctttgtgatagttttgcacccactggatgacccagaatcatcttcctcttttaagatcagctgattagcaacgtcagttccacccacaat

SEQ ID NO: 31061 - DNA, 201 bp, Homo sapiens
ccacagagcggctgtcagattccaaaggcatcataccatctgcttttccaatcttctgctcttcaatgtagacatatgttcgagtggttcgtgtgtgtgcstggtgaggggggtgctattttccgggggaagaggaggaggagaggatgcttaactccaagagtcctcaaagcaaactgaaataaaattttaagtgatgcc

SEQ ID NO: 31062 - DNA, 201 bp, Homo sapiens
tgttcccttcccgcttcccacctgcctcgtatggaaaacacccaaagtaggcactgtttatagagccatcgcttgcagaacatctccccggcctccgacayatgtgccataaatgctgcagagctgcgtccacagtccctgctccggagaagagcattttgcttgttttcaaacacaagcatcctctcccgcgcctgggag

SEQ ID NO: 31063 - DNA, 201 bp, Homo sapiens
cctggagctacgacgagggtaccctggacccctgtcctaaatgttctttgactctgcttagccactgaggatgtttgcatttgattcatttgcttattatkatcaagaaacgttacctgtcaacattggataaaccatccgagggaaattaatcaaaacccccttcagacaaactgcatcacatcgattctctccttatag

SEQ ID NO: 31064 - DNA, 201 bp, Homo sapiens
tgactgcaaggactcagtaaaacaaagtatttcaaggtcatgctacaaaaagtcccaccaagagcatggtcaggaggtacagtgcacttacccacacggakcagagagggatcagaggaggctggctggggaaatgatcctagggctttcttaaaggacacagcgccatggttatttaagtacagcttttaaggagaacta

SEQ ID NO: 31065 - DNA, 201 bp, Homo sapiens
ctattattttgatgttgttagctttcaaagattaattccacagagatttttgggcatctttttgataatacacattatgcttgacttgggagtttcaggakgcgcaagagactccttttgactgcaaggactcagtaaaacaaagtatttcaaggtcatgctacaaaaagtcccaccaagagcatggtcaggaggtacagt

SEQ ID NO: 31066 - DNA, 201 bp, Homo sapiens
caatgtttctgtctcaactggttgattggaacaacatacaaactgacccttaggaaccttctaccaaaaatatcctgtgaatcttcatacttttgtaatascgtttagttagaagtggtcagactttcttcgtcctcttttcgtgatttcctctgtggtgtctgtggatcgataccggcagctcaggtaaggaacgtgtgc

SEQ ID NO: 31067 - DNA, 201 bp, Homo sapiens
aggagaatcacttgaactcagaaggccaaggttgtagtaagctgagattgcaccactgcactgcagccttggcaacagagcgagactccatctcaaatcartcaaccagtcaatgtgtgcccccttttcctccaactcccaccccaaatccttgctgaatcatacctatccttcacctttataagcatctagtttttaaat

SEQ ID NO: 31068 - DNA, 201 bp, Homo sapiens
atatggtggccactgcatgattttgctcaggactgaattagaggcaggtgaaaggccctcactccctggaatcagctagcgatggctaaggctcctgtgasggtttctacagaggttccacccagagaggagagtcaaatgggagtttctaccgatgctcttgaaaggatcttgttactcagatgtctctaagacaatgat

SEQ ID NO: 31069 - DNA, 201 bp, Homo sapiens
cctcccaccaggccccacctccaacactggggattacaattcaacatgagatttcggcggggacacagatccaaaccttatcaccagcgcttgttatttcytcaggtacattttgatgtccctccccactttactctcccctacaccttgaagcaggtgcaatcattttaggctatgaggaccagcatcgaccttcatcag

SEQ ID NO: 31070 - DNA, 201 bp, Homo sapiens
tgtttgttttgaaccacttattttggcaagacttcttcagacaggagagccctgagagctcttcaaaggctgggcctgatggtgtttgtcagagaggttcragctcttaaatttaaatggcctcccacagggaagcagaagtccttttggatcctccagaggactgagatcctccagatgctgttcatttgccttattcgt

SEQ ID NO: 31071 - DNA, 201 bp, Homo sapiens
ttgccttgtctggtttttcaaagtgctcttttaacaaatgaaagtttaaagcttgagttcaatttgagtaatttgttcccagagaaaaagtaaatgaaaartatttctgggtatttttaatgacacaagtttctgtgctgatatgcgggcaggggttcgggagtgggggcaccagggctcatgagccgagagcccctgctt

SEQ ID NO: 31072 - DNA, 201 bp, Homo sapiens
ctgaggattttcacatgcacatctgttaaatgccatttaaagagaacactaacaagagaaagctagttcatttttcttcctgggacctcagtttcctcatyagcagaatcgggatattagtgcagaccttgcaggctctttatgaggatccatcgggagcctcaggcgcacactcggggagcattggagctcttcccaggc

SEQ ID NO: 31073 - DNA, 201 bp, Homo sapiens
tgcccttccccactacagtgtaaactccatttggactttctctagttcactgtgaatggtttttgaataacatcaattagcataacctcatgcccagcatsgtccttattgttgagagcacagcagtgacaaaggtgcaactcttgctcttgagcgatcacagtttatttggggaacctggtactacctaataaaaccagg

SEQ ID NO: 31074 - DNA, 201 bp, Homo sapiens
gaatcattttctttgattctctgcccttccccactacagtgtaaactccatttggactttctctagttcactgtgaatggtttttgaataacatcaattascataacctcatgcccagcatcgtccttattgttgagagcacagcagtgacaaaggtgcaactcttgctcttgagcgatcacagtttatttggggaacctg

SEQ ID NO: 31075 - DNA, 201 bp, Homo sapiens
agatttatccctgcccgaatcattttctttgattctctgcccttccccactacagtgtaaactccatttggactttctctagttcactgtgaatggttttygaataacatcaattagcataacctcatgcccagcatcgtccttattgttgagagcacagcagtgacaaaggtgcaactcttgctcttgagcgatcacagt

SEQ ID NO: 31076 - DNA, 201 bp, Homo sapiens
caaaatgctgatagcaatatggacaataatgtccaggctgaggtggtctcagatggagatgaggagctcgttgggaattggagcacaggtgactcttgttwtgttttaacaaagagactggcagcattttgcccctgcgctagagatttgtggaactttgaacttgagaaagatgatttagggtatctggccgaagaaatt

SEQ ID NO: 31077 - DNA, 201 bp, Homo sapiens
ggctttgcccaaaatgctgatagcaatatggacaataatgtccaggctgaggtggtctcagatggagatgaggagctcgttgggaattggagcacaggtgmctcttgttatgttttaacaaagagactggcagcattttgcccctgcgctagagatttgtggaactttgaacttgagaaagatgatttagggtatctggcc

SEQ ID NO: 31078 - DNA, 201 bp, Homo sapiens
caaaaggagcctatgtagctttgggagttctctatttagtcaccttattttttttgtcttcttgttaaactagcatcctgttttactgaatctctgcctcmgttgctttatttactgtatacatacatagctcttttgaagacttgatgtcaaaagtaaagaagttcagaacctacggggcttgctttgggtcccaaatta

SEQ ID NO: 31079 - DNA, 201 bp, Homo sapiens
acaagagagcaggtatttattgagttatgactgtcaggcatggaacagatccattggtcagaaataaggaaattgtctctaccttcaaggttctcacagtytggagggaacagagagccatcagggacaataggtccctgtgccatcagctactgggatgtatgactttccagtagaggtacacagcacttgttccaaaag

SEQ ID NO: 31080 - DNA, 201 bp, Homo sapiens
tattctttcctgatcaggaaactccgcagagagaaagtgacagttgaagactatattgaattttggcccacaggaaaaggaaactttgctgttagggtcasctggaggagagactgcaggggtcagagatcagggccatatgctagagctgcaatgtgggtgctcaaatgatgttcagtgcatcttcacagatggacctcc

SEQ ID NO: 31081 - DNA, 201 bp, Homo sapiens
gtgcggtggcatgattgtagctcactccagtcttgagctcctggactcaagagatcctcctgcctcagtttcctgagtagctgagaccacaggcacgggayaccatgccagtctaatttttaaattttttgtagggacagggcctcactgtgttgcccaggctcatctcaaactcctggcttcaagtgatccttctgcatt

SEQ ID NO: 31082 - DNA, 201 bp, Homo sapiens
tactgctccatcaatacccatcccaggagacagtggcagtcttgatgtcaatcttgttttaggatcattgccagtggaattcaggactgcggttctacccrgtaccggggaaccaggtgagggggttaagaggcctgggcccatggaaggggtgagagagagccacatacttacagttgtgaagggggccagccaggatgg

SEQ ID NO: 31083 - DNA, 201 bp, Homo sapiens
tagactgtgaggtatgaagtacctcacagtaaagaagtcatgttattgctggaaaaggggacatgggtattaaaaagacaaaaacaacagggcttcatcayagcagctatactgctccatcaatacccatcccaggagacagtggcagtcttgatgtcaatcttgttttaggatcattgccagtggaattcaggactgcgg

SEQ ID NO: 31084 - DNA, 201 bp, Homo sapiens
gtcacatgtaaatcattgagccaatcaccgtctttctgtctggacctggaataaagaccaccttagagcatgggagcgggatccccttgatccacaccatrtagactgtgaggtatgaagtacctcacagtaaagaagtcatgttattgctggaaaaggggacatgggtattaaaaagacaaaaacaacagggcttcatca

SEQ ID NO: 31085 - DNA, 201 bp, Homo sapiens
ctcttcttattatagtgcaaggtgtttggcagaggtgtggtagctgaaggcccaaggataacattgtccagattttcagtctttggagccataaacatccrgttctttccagccccgctcaaccgcctctcttaattcaccaccctgttagcttcatctcaggccagacattgtaggtggcagcaattgtaggacaatgag

SEQ ID NO: 31086 - DNA, 201 bp, Homo sapiens
aaatctggaatgatctactggcatcatgcctaggactttggaaaacttgaaggttggcacctttggggaaaaccagacttttgaagcaggggctctgattktctcttcttattatagtgcaaggtgtttggcagaggtgtggtagctgaaggcccaaggataacattgtccagattttcagtctttggagccataaacatc

SEQ ID NO: 31087 - DNA, 201 bp, Homo sapiens
gagatgtggcagagggtaggcagagagattgcaagcagggaaggatttcacgtactgccactggctttgaagatggagggggcacatggctagaaatatgrgcggccctcagaagctaagaactagctctttctgacagccagaaggaaatagggaccttccacctacaatagcatggaaaacggggacctcagttctgca

SEQ ID NO: 31088 - DNA, 201 bp, Homo sapiens
agctgactttagaataggaaggttatcctgggtgattagcatggatcagagttctcacaggagcccttcaaagcagaaggggaaggtggacaagagaatcrgagagatgtggcagagggtaggcagagagattgcaagcagggaaggatttcacgtactgccactggctttgaagatggagggggcacatggctagaaata

SEQ ID NO: 31089 - DNA, 201 bp, Homo sapiens
tgagccagaggtctgtctcttgcggcatttctgcttttgagaacctcccgtttcctgaaaggcaccagaccccaagacagctctgctgcctgattggtagrtgcccatgacagctctgcttcatgcctgctgcctcctcatccctctggatgccttgtggtcctgcttgtctgaagagcataaacttgggggttcccactc

SEQ ID NO: 31090 - DNA, 201 bp, Homo sapiens
attatttatttgttgtcactgtttgggacccctgttgctgtctcaccaaagaacttcttgtctcccttttagaagtttccagagcgtcttcctgatgttgsatagagcactcacacctaacagatctcagaacttgtatcttttctgggtggctagactgaaaaatccattttcttatgagtgagccagaggtctgtctct

SEQ ID NO: 31091 - DNA, 201 bp, Homo sapiens
acctgcctccgtggtttgtcaggacatttagaaatgcagacttgctcaagacctggatctcaggtggtaggttggtccacagacagtggcaccactagctrttatttatttgttgtcactgtttgggacccctgttgctgtctcaccaaagaacttcttgtctcccttttagaagtttccagagcgtcttcctgatgttgc

SEQ ID NO: 31092 - DNA, 201 bp, Homo sapiens
gccaaaaagaatgtgccacctagatgctatttataaccattttcacctcttgcctccaggggctaaattggaaacctaattttagatgcataaaagccaawatatgtataggagaagctccaaaataaaatatcccagagtggcttgtaagcatccttccaacaggttcaggttgatttaccttgctgtggatatttaatt

SEQ ID NO: 31093 - DNA, 201 bp, Homo sapiens
tacatctttcagcctctaccacattgaattggaattatatgtctgttttatgtaccatgctgtgaactccttgaagataggagctgtcttatcttcaaggygctcaagacacgtttgttgcatcagttgaatggagtcaaattataaacaggtgatgggggcaaatatcacaatatgatactctgaacatcttctctgaca

SEQ ID NO: 31094 - DNA, 201 bp, Homo sapiens
cctccctttccagataaaagttgactctcataattgtaactctcccctactttatcagcatctacatctttcagcctctaccacattgaattggaattatwtgtctgttttatgtaccatgctgtgaactccttgaagataggagctgtcttatcttcaaggtgctcaagacacgtttgttgcatcagttgaatggagtca

SEQ ID NO: 31095 - DNA, 201 bp, Homo sapiens
cagaagagtgtaggacactggaaaagtagcagggtgtgcgattgcagggatgggaccagcagtaaaaggtagccctgccaagaccattaagcttcctgcarctccttctggatcccacaatttgaaggggaaatctttcccaccgcacatcactgtttggtggactaaatggctccccgatgtcccgaaagagcacagctt

SEQ ID NO: 31096 - DNA, 201 bp, Homo sapiens
agagggcgatggctccactctgtgtggccccgtcaatggcctggacgcagctgaaaaaatccagaagagtgtaggacactggaaaagtagcagggtgtgcrattgcagggatgggaccagcagtaaaaggtagccctgccaagaccattaagcttcctgcaactccttctggatcccacaatttgaaggggaaatctttcc

SEQ ID NO: 31097 - DNA, 201 bp, Homo sapiens
gccttgctcttgcagtttctgacacatcaccattgatcagtcctgggaaacaaacaaaatagagggcgatggctccactctgtgtggccccgtcaatggcstggacgcagctgaaaaaatccagaagagtgtaggacactggaaaagtagcagggtgtgcgattgcagggatgggaccagcagtaaaaggtagccctgcca

SEQ ID NO: 31098 - DNA, 201 bp, Homo sapiens
taacccatccagacctggagaactcctagagggagaaacagggaggacccaggcacataaacttgcagagcagctgagttatcagatcttccaagccatgsggttatcgagctttatcagagcagccttgctcttgcagtttctgacacatcaccattgatcagtcctgggaaacaaacaaaatagagggcgatggctcca

SEQ ID NO: 31099 - DNA, 201 bp, Homo sapiens
aaatggccaaaagtttgtttcaagtctagtctgatgaataaagcaggagatttatttttggcaaaagtggcaaataaagagggctgatttttgtatatggstactgaaatggcttagaatgccattttatcacatggtcaaattattcaatgatcaaatatcgaattattaaaaattatcaaaaggaagttccctgaaaca

SEQ ID NO: 31100 - DNA, 201 bp, Homo sapiens
ggttaaatcttgtaaagatgctttttaaagcatattaatccattagtaatccatttggatttgggaatacggtcatatactgtttggtacaatatgtactraacctggtcctggaaaattaagtggaaatataggtttaaactactggaacttcaaaatagcttctcagtaattccttctcagcaatcattccaattccta

SEQ ID NO: 31101 - DNA, 201 bp, Homo sapiens
agactggccataagttgggagggtaagtaattggttgtgattgaaaggaaagaaggaggtaatgatgagttttggtctgggaaccggagaatggtggtccrtggacagaaatagagaaggcaagatgagaagatgcaataggcaaaggcagtgagtttaatggttgacttttggtatttgctgtgtatgccctctgtacct

SEQ ID NO: 31102 - DNA, 201 bp, Homo sapiens
gaggagaacatagtccaggttgaaccttgctgcctgccctctggttgaaacatcagtgttgaatcaatagaccacgtcctgtccataccttgggaattagrctcacccagactctgagttaagagtttctatgagacagagggctggactgggggagcaaggcttgcaaatcgaaagcatcagttgctacccctgagcacc

SEQ ID NO: 31103 - DNA, 201 bp, Homo sapiens
gctcagggcctgggaagtggtagggagggaccttcccagaagagagatgactcaggctggtcccaagcccctcctgtagaacaaacagacaaggtgaggascaaggaggcatttggaggtcatctggcccagcacccttgtctggaagacagatttaagttccataaagtcacttaggaggagaacatagtccaggttgaa

SEQ ID NO: 31104 - DNA, 201 bp, Homo sapiens
aaggaaaatgctgtcctcgaaatgttcctggcaccgttttcaagaggtgccgaccaagcgctggaattgctgacctccctgaaagagaagcctgcagctgyggcctctggggtgaattccccccatgggaggacctggtggagttaaaacagactatatccacatcacagagagctggcccattgctcagggcctgggaag

SEQ ID NO: 31105 - DNA, 201 bp, Homo sapiens
ttgctgggcatgtgcttgaaggagaaaggtgaggatacaaaggcaatgagtacatgatccttgaccttgagaaacctatagtctaatagaggaggcacatrtaaaagtaattaggtaaaatatagtgcagaatatgcagtcatggagtcatctacagatctgcctggaatacagagggacaagtgtttagtattttccaac

SEQ ID NO: 31106 - DNA, 201 bp, Homo sapiens
taaattgaagtgtaaatattcgaattattttcataaactcttcagttctgttgggcttttatgttatcatacagtgatttttttttttgtatttaagtttyctagcagttctcttttttaagagcctcaagtgtccaataaaaagcaaatacttgaattttcagtttctatatagtgcatattttttctcctgcttgcctt

SEQ ID NO: 31107 - DNA, 201 bp, Homo sapiens
agcacctgctgatggaaaggtggactcactggtcatggggagtacagtaaaattaggagagtagatagaatcctgaagcatttgagctgcaaaatcatagyaacaacagctcttaatatcctataattgaaaaagagattgccattttcaaagacctttcacagtcattctcttaatcaagtctcataataaagatgtcat

SEQ ID NO: 31108 - DNA, 201 bp, Homo sapiens
accatttgctaatgaaagttctagctgccataatttcagcacctgctgatggaaaggtggactcactggtcatggggagtacagtaaaattaggagagtaratagaatcctgaagcatttgagctgcaaaatcatagtaacaacagctcttaatatcctataattgaaaaagagattgccattttcaaagacctttcacag

SEQ ID NO: 31109 - DNA, 201 bp, Homo sapiens
taaaaaaacataagggaactttttttttcaaacactgtaatgagggtattcaagtctgcaggcaaaacagagctgtttgaaaagacattagcctcgaaacygcactgtgccagaatagatacagctacgtcaaaatgccgcatttattttgccattacttttcactgactaaaaccatttgctaatgaaagttctagctgc

SEQ ID NO: 31110 - DNA, 201 bp, Homo sapiens
cctcccaaagctcacgaactgagagtcaggaggcgtggttcccctaactcaaatcagaatttcgttatcaaaagaagagagggatggttctgtggtgtccsacactcaaataaacatcctttaaatacctctagatgcttataattcctgttgcagccttagtcagtgggagccactgacctgcattcgtgtaggaactga

SEQ ID NO: 31111 - DNA, 201 bp, Homo sapiens
cgaatcctaaacacgctgcacaaggaagaccttatgctgacagtagggaggaagcgacatgttaacaaacaagtttgccggccaggaagttttaatcagcsctttctactgcagggggtatgatggatggagaccctgtttcagaggggtttcctttagataaaacaataataccatgctttcaagaagctcgttcgacag

SEQ ID NO: 31112 - DNA, 201 bp, Homo sapiens
gatgatagtggggcctcagatttcccacctattgttttgaactctaattagggaaagggaatttggaaccattgtcttctctgagtgtgcagacacgatgytatcattgtgtttacagaggtggtcagattcccagcacagtgtactcccgcacagataaccgtcccatcttgataaaacaatgctctcagccgaatccta

SEQ ID NO: 31113 - DNA, 201 bp, Homo sapiens
catttgcttattggaatcacttcgaaaaggaacttggtatcgttcacatgtgtttataactctcaaatcttcttcttccaatttttaatcttgatcaccasagctttataacaggaagaacgctcaaagaagaaaaatagaagaagcctgaattttaatttgctatttcttcacacacaaaacaccccaagctcaatcaat

SEQ ID NO: 31114 - DNA, 201 bp, Homo sapiens
gtcattgactcagaagatagtttcttaccgtttggggaaagtgcttgtctattcctctccaaagccattttaaaaaaaaaattgcaccagttctcatcccrtcatctgccttgatcaaacatttgcttattggaatcacttcgaaaaggaacttggtatcgttcacatgtgtttataactctcaaatcttcttcttccaat

SEQ ID NO: 31115 - DNA, 201 bp, Homo sapiens
ggctgggagatttttccatctaaatagcttaattgttactctacagggcaatcataaatgtaaatcgacttaatatgacttgattgttagtaatgactgtscctctaatgacgctggccaatgagcctacacagaatgtcgcatgcagatcaatgagccaaatgttagcaggggactgggcatttgaagatttaaaaaaat

SEQ ID NO: 31116 - DNA, 201 bp, Homo sapiens
ccctttacatgaccattccagtcatgaaacagagaatctggtcacctgtcctttatcttggctggtccaattccataagaagtaaatgctgtgtgtctgcrattcaaaagacccctttcacgggaggctgggagatttttccatctaaatagcttaattgttactctacagggcaatcataaatgtaaatcgacttaatat

SEQ ID NO: 31117 - DNA, 201 bp, Homo sapiens
agccactaacacgggatctgtcaattgcattgctggtgatcaagaaatgccagctcctccgctcttccctgagtgccttgttggagacaaaaccagcaggrttatatccccagcactgtaatttagtgtggcagtcaggggaaaacaccttgtagaatttcatttcttatcatttaatgtcccctttaattctcatttaag

SEQ ID NO: 31118 - DNA, 201 bp, Homo sapiens
ccatatgcatcgtattttaaatggaacagggaggttgttccatgcgtcaacttagtccaaatgtagagggtcaggaaaacaatgatatgagaaaagggccrgttactgtctgggaatccataaatactgcttggcaaatggcacattgcatgcttattccttaggcatccgtttagcaaaataagatgtcaagctaattgt

SEQ ID NO: 31119 - DNA, 201 bp, Homo sapiens
gtttgttctttaagcaaaaccatatgcatcgtattttaaatggaacagggaggttgttccatgcgtcaacttagtccaaatgtagagggtcaggaaaacartgatatgagaaaagggccggttactgtctgggaatccataaatactgcttggcaaatggcacattgcatgcttattccttaggcatccgtttagcaaaat

SEQ ID NO: 31120 - DNA, 201 bp, Homo sapiens; identical to SEQ ID NO: 4866

SEQ ID NO: 31121 - DNA, 201 bp, Homo sapiens; identical to SEQ ID NO: 4878

SEQ ID NO: 31122 - DNA, 201 bp, Homo sapiens; identical to SEQ ID NO: 4886

SEQ ID NO: 31123 - DNA, 201 bp, Homo sapiens; identical to SEQ ID NO: 4869

SEQ ID NO: 31124 - DNA, 201 bp, Homo sapiens
aaataagactatgtcatgaaagctttagaatatccaacacattatagaatattttcacggaaatatttcggatggaattttggctttaattctttctcttyttttcctgttcttttccctctccccacaaccacttctgtttcattttctgttttgctccttcttttcataagtagctggtagtcagtgttctctttttct

SEQ ID NO: 31125 - DNA, 201 bp, Homo sapiens
ggaagacattcttcttttttatctgccaacctcccagtgccacagtaagcacagagtcaggcctcgaaaaataccagtcctttcgcctgtcccctctcacrtggtttgaatccaagaggctgtcataccaggctcccccattcagtatattttctttatgtttaaatagtttggattgacttctcttttcttttatttttc

SEQ ID NO: 31126 - DNA, 201 bp, Homo sapiens
tcttgaccatcttatgcctgaaataagggaagacattcttcttttttatctgccaacctcccagtgccacagtaagcacagagtcaggcctcgaaaaatascagtcctttcgcctgtcccctctcacatggtttgaatccaagaggctgtcataccaggctcccccattcagtatattttctttatgtttaaatagtttgg

SEQ ID NO: 31127 - DNA, 201 bp, Homo sapiens
tttctgtccttaagcactcacaggtagcttaacagtaatgccttggattccttccttcaagagcgacagcaggaagcccagcttctctggtagcagagcasgggtcctcaaagcagaccgtgaggtcagaggagcactggagtcaggagtttccatctccaccctgctgagtaaactgtagttacccacacagaaaaggag

SEQ ID NO: 31128 - DNA, 201 bp, Homo sapiens
agttaaaaaggtgatctcactaaaagtaattagcataagacctgctggacctgtagaagtgactggatggtaatcaatagcaatatgattacacccatgcrgcaattataaattatttaaaacactacccctaggttactgactagttgcctttaaattaaattctctgtcgataattgatgcaaagaattaatgtgagaa

SEQ ID NO: 31129 - DNA, 201 bp, Homo sapiens
tataaaaggaagcatacagtgggcctcattctgacaaatttttagtaaatcacaggttgcctttcctaaatccctcaatatgatggctagtctgtttcatwgtgaataaaaagtgatcctggatgaatgaataaagtgaaattcagataatttttctcaaaactgaaattgtttacatcttcctttagttctcttttttct

SEQ ID NO: 31130 - DNA, 201 bp, Homo sapiens
atggtgctgatgtcttcacttcctgccaccttggcaacctttgtagttgctctctttttgccaggggaacaaattaagagagagaagagtgatagtgtctrcatgtggtctgctcactcagccagtattttccacagccagtctttccctagaccagcatctgagcgtgccttgtctatgggccacctatactattattta

SEQ ID NO: 31131 - DNA, 201 bp, Homo sapiens
tcaatgattttctttctggcttgtctacgccaaaatggttcttctgctcagttggtttctatagtgattttatggatataggcattttcttctcgaattaraagaactgacagtccaggcacggtggctcatgcctgtaatcccagcactttggtaggccgaggtaggtggatcacttgaggtcaggagtttgagataatc

SEQ ID NO: 31132 - DNA, 201 bp, Homo sapiens
taaatacagatagacaatatttgtacatgataggttggctcaccattaatcacttaagaagtaatagaatgatcaatgattttctttctggcttgtctacrccaaaatggttcttctgctcagttggtttctatagtgattttatggatataggcattttcttctcgaattagaagaactgacagtccaggcacggtggct

SEQ ID NO: 31133 - DNA, 201 bp, Homo sapiens
aagcattccctgtagtttttagcataactagtactggctcagtaagtatccactggggttcggaatacaactgccctgcctcttgagcagccatgcctgcytccgaggtggtgctgcatgctattcaggaggacagaccatggatgggaatcctgagccacaactccttagcctcatgacgttgggcagatgactgagctt

SEQ ID NO: 31134 - DNA, 201 bp, Homo sapiens
ctaaatcctaaattgaggcttactaggaaatgcactaggtgacaggctctagagaaatggctattaccaggttgctcaggctggagtgcagtagtgcaatytcagctcactgcaacctctgccttctgggttcaagcaattctcctgcctcagccttccaagcagctgggactacaggcaggcaccaccatacccacctaa

SEQ ID NO: 31135 - DNA, 201 bp, Homo sapiens
gcttcgatgaagcttgtgtccaccacagtttccagtgcttctgcacctgggtggtcagaaatgagtcctgtgagacacaggtgacaagatctccaaggagscagttcacgcttggatgactctggagctgtggtgacaatctaaatcctaaattgaggcttactaggaaatgcactaggtgacaggctctagagaaatggc

SEQ ID NO: 31136 - DNA, 201 bp, Homo sapiens
ggcttcgatgaagcttgtgtccaccacagtttccagtgcttctgcacctgggtggtcagaaatgagtcctgtgagacacaggtgacaagatctccaaggarccagttcacgcttggatgactctggagctgtggtgacaatctaaatcctaaattgaggcttactaggaaatgcactaggtgacaggctctagagaaatgg

SEQ ID NO: 31137 - DNA, 201 bp, Homo sapiens
aatgacaagaaaagtggagaagatgagacagacaaaactgcaactcatcttcatggcacactggtgagtgggggagtgcaagaagtttaggtgcaaaggamaatggagtgaacatcttggcttggttaacagaagaaaagaataccaacgccgtctattttcatatccctttctattttatgtacatatttatcaatatac

SEQ ID NO: 31138 - DNA, 201 bp, Homo sapiens
gtggaatatgaagtagctcccatccttattccatcgcccatatgctaaaatgtagattgtattagttgagaaattttaccaaatatttacttatactgtgstattatttatactatttgtcaattccactatagtagatgcttaataaatatttgtgaatcagtaaatggatggatgaatgaatagtggcctacttctgtg

SEQ ID NO: 31139 - DNA, 201 bp, Homo sapiens
gtaaatgtggcagacaataaaatttccccaagcactttgatgatgtttgtgttaatacttcctgctcagagctgtagcccatcagattctagagctaaccraagagggaagacaacctgtcttctcccagtttccagcctgtatagacttaatcattttcaaggtttaaggttgtttttgtttattggttggggtggagag

SEQ ID NO: 31140 - DNA, 201 bp, Homo sapiens
tttggtgattgagtagaacttggtgccatattggctcaacatggaagatttctgtgatcacttattgatcagtcatgaataaggaatcgggatggcagtcrggagtgtgccaacacctctctcagtattctgggtctctctgcatgtagtgtttcttttgcagctcctagagataaattttttaatgtattacatgtgagt

SEQ ID NO: 31141 - DNA, 201 bp, Homo sapiens
tatagcacaagtgtcttcccctgttgtaacatagtgattattaatgtcaaatatcagctagataaaagctgtcaagtgatagaaagtccttatagctcatraactcttcaataactgggaatttataccgtttatagtttttttactgctaagaataatgttgcaatgaaacgtttgtatataatgctgtttagtcccctc

SEQ ID NO: 31142 - DNA, 201 bp, Homo sapiens
taagctgacccagtgaccttgctctagctcaccagggactgagcatacaccaaagtggccagagctagtggttgctgactctcaggatctttggccctgasagaacaacaaagactggcctattgaggcaggaagtcttaacttccttggccagcctgaaaggctgtctccaaccatgcggacacagcgcagtgaagcggt

SEQ ID NO: 31143 - DNA, 201 bp, Homo sapiens
acagcacatgtggagggaaagaccgcagaattctggcggggttataaatcatacagtcaaataatttccgtgcaattaatatcctcaaattaaaacatacstttttaaagaaagattttgcagacttttaagctgggcaactgtctgccttacaagatgcgtctggaaaccccagtgccatcctccttttttagtcttgta

SEQ ID NO: 31144 - DNA, 201 bp, Homo sapiens
cagtgataattatgaatctcataatggaaaacatcccgagcccgaacatcaatcagggaagataaacaatgggaaatgataggtgtacaaaagggaaaatrgcaacagcacatgtggagggaaagaccgcagaattctggcggggttataaatcatacagtcaaataatttccgtgcaattaatatcctcaaattaaaaca

SEQ ID NO: 31145 - DNA, 201 bp, Homo sapiens
acctctctgtgccttgatttctttcacgtcttgttctagttttgaagagcgattcttgtgtgaattcagggagaggaggcatgaggcatggtaaggccacygtacgtctgtggttgacaaattcagtaggcccacagtcaatgcaaaagtcctcttgcctctgcagcacagttacaatgaagaggagcgatggcatggcat

SEQ ID NO: 31146 - DNA, 201 bp, Homo sapiens
aagaatgttcacacagttgttcacaaacatattgatatcagaccttatagcagtcctattggctagatcagttattatgaatgtgttttatagagtaggawacagagatgcgacgtgacttgcctaagaacacacagcagttctgaaactcaccctgtgctaatctgacctcgtgaagaaattgagcaaactaggctccag

SEQ ID NO: 31147 - DNA, 201 bp, Homo sapiens
aagagaaggtggagtgatactgaataccccgtaaaatcacacaatcagcacttaagaatgttcacacagttgttcacaaacatattgatatcagaccttayagcagtcctattggctagatcagttattatgaatgtgttttatagagtaggaaacagagatgcgacgtgacttgcctaagaacacacagcagttctgaaa

SEQ ID NO: 31148 - DNA, 201 bp, Homo sapiens
ttgtgcaaaatattctagtagtaaatagaggctttaaatccacacgttgataatggtcaaatcctcttaaaggggccagcaacaaaaatgactttaaaggkgaaatattccttcaatgttacaagcgcccatgagcatgttagtagagcagttgtgtgttgaagaaagagaaggtggagtgatactgaataccccgtaaaa

SEQ ID NO: 31149 - DNA, 201 bp, Homo sapiens
gtgaatccatgtcctgtggtggccctctcaggagggattgtgattaaagaatggacaacccaagggaatcatgtgtcatggtggagcatacaggccagcasgtgagttggggaggcgcctttacagaggaaaccttgagcttcttctgtgatattcattacagaacttcccccaaagacagatgacatccatttataatta

SEQ ID NO: 31150 - DNA, 201 bp, Homo sapiens
atctcgtcgtaattttctcaaatacccttcctctttcctcacttttggtgataactacctgtgttgctcttgtcacttttgcctggatccactaactcacyacctaggtatctgcaacagttatccattgctgcctaacaaattaccccaaaatgtaagcacttagaatctcattgtctttgtgggtcaggaattagggag

SEQ ID NO: 31151 - DNA, 201 bp, Homo sapiens
ccatgcccgggtgcacaaagccagcatcagtgacctgcacaccaggaggcaggctgcatgatgattgggtgcaagtccttaggtgggtcactcagtctttsttttcttgagttttttcatctgtgaaagagtgatcataatactatttccattgagaagaagaaataatttatgtaaagcacaaagcataatccctggtat

SEQ ID NO: 31152 - DNA, 201 bp, Homo sapiens
gccccctgggagtcagagcgttccctccctccttgccactgtaaatgactatttctgtcgtttgcagagtgtccttttctttctcctacagccccatcctyaccctctatagccatcaggtcaggtgcgtcttcttcatttatttatcaaaagggccatagcaatcattgcaaacatgtttaggaggatttggaaaccatg

SEQ ID NO: 31153 - DNA, 201 bp, Homo sapiens
tgggctgttcaggtcgatttggccaagcaggacggcatcagcttgtattggagggaacatctgagcagctcagggccccctgggagtcagagcgttccctmcctccttgccactgtaaatgactatttctgtcgtttgcagagtgtccttttctttctcctacagccccatccttaccctctatagccatcaggtcaggtg

SEQ ID NO: 31154 - DNA, 201 bp, Homo sapiens
gacaggtacggccgtgcagctttctgggctgttcaggtcgatttggccaagcaggacggcatcagcttgtattggagggaacatctgagcagctcagggcyccctgggagtcagagcgttccctccctccttgccactgtaaatgactatttctgtcgtttgcagagtgtccttttctttctcctacagccccatccttac

SEQ ID NO: 31155 - DNA, 201 bp, Homo sapiens
tacccattaccagggaagcctccttcctcccagcagattcccagcatcttctttcacctctaggagatattttccaaggtcactaaattaagccttcagasaatcgaaaaattgaatctcagtacctctattttcctaacaaaatttctgcagcaccgattggggctgacaggtacggccgtgcagctttctgggctgttc

SEQ ID NO: 31156 - DNA, 201 bp, Homo sapiens
cttcaagacctggcttctgctccctgtcacagtggcaaagacaatgacaataaaagcacagcctccagagagaagagccttcgatggacctgggtgttaawccaggggccaggcaaaaactgggggatgcagaataggaggttgggctggaggtgagtgagaagaacggatacggttaggaccaacatttaggcaatatga

SEQ ID NO: 31157 - DNA, 201 bp, Homo sapiens
tttcctgcccccacatgttaaagatggtgcaagggaaccagagagctttgatccctggtttctctggtcacaaacctgctctcctctccagaactccaggmtgcctttctgtgggggctaaatcaaatttagctgttcccccaactgcaaagtacataggcatcaagtgaaagggtaaatgcatgaaaacctgaatggctg

SEQ ID NO: 31158 - DNA, 201 bp, Homo sapiens
tgaatatgtttcttctttgcctcttgaggactaaccagccgggtttagattatttcctccccgtgtcgctttcctgcccccacatgttaaagatggtgcamgggaaccagagagctttgatccctggtttctctggtcacaaacctgctctcctctccagaactccaggctgcctttctgtgggggctaaatcaaatttag

SEQ ID NO: 31159 - DNA, 201 bp, Homo sapiens
attcaacccacaataagagcacagtggtgaggtttgaggggtggtatgaggtcacagtcacagccacccctctcaccagctgtgtgacaattctggatttmcttagctgtcctctgcctccatctccctttctctgtaagtggaagtggtattcattgatcacacactacatgccggacaccaagctattacattttttga

SEQ ID NO: 31160 - DNA, 201 bp, Homo sapiens
cttctcctgtgttcctttcctgtctgcctcaaatctccctctacctttctgctatgaagacacttgtttttggatttagggtcttcctggctgatctcatstcaagatccgtaacttaattacatctgcaaagacctgattcccaataagcttgccttcacaagttgcagggatttggatatggaactgcctttttggagg

SEQ ID NO: 31161 - DNA, 201 bp, Homo sapiens
atatcactccaatccctgcctctgcagccacatggccttctcctcttctcctgtgttcctttcctgtctgcctcaaatctccctctacctttctgctatgwagacacttgtttttggatttagggtcttcctggctgatctcatgtcaagatccgtaacttaattacatctgcaaagacctgattcccaataagcttgcct

SEQ ID NO: 31162 - DNA, 201 bp, Homo sapiens
gaccagtctggccaacatggtgaaaccctgtctctactaaaaatacaaagattagcctggcgtgccctgtaatcacagctacttgggaggctgaggcaggwgaatcgcttgaacccgggaggtggaggttgcagtgagccaagatcgtgccattgcactccagcctgggcaaaaagagtaaaactcagtctcaaaacaaca

SEQ ID NO: 31163 - DNA, 201 bp, Homo sapiens
ctaagaagcctctgcctgaccacgtgagcatcatggaacccaaagatgaggtagtgcccaccactcccatctcagaacagaagggtgggaagccagagccrcctgctatgccccagccagtccccatagcataacgggctgtccttggcagttgtattcggagtctggatgttgctttgtaaagacatttaataaaatatt

SEQ ID NO: 31164 - DNA, 201 bp, Homo sapiens
gtaattcctaaacaagagtcatttgtaaattagggaggaagagctaaaaaagattcctagcaagaaacatcataaaggggcttgataaagccaaaaaactraaagaaaaaaaaaaaggaattagaaacagagaaaagaggcttcgtgttgtttgtaaatttgtgaataaatctgttaaagaaatattggattcatattcaa

SEQ ID NO: 31165 - DNA, 201 bp, Homo sapiens
ttaggtggtttttattgggattagtggatgaacttaggattagtgtggcccttccttgagatataatgacaaccttggtgaaagcaagaccacagggcctrtcttcagggaagtgccttgcattttaataccaaccatgccacgtgtatgtgtttcctgggcctgccataacaaattatcgcaaactgggtagattgagaa

SEQ ID NO: 31166 - DNA, 201 bp, Homo sapiens
catttccatgagtagagttggccattgcccactaagaaaatttaggtggtttttattgggattagtggatgaacttaggattagtgtggcccttccttgaratataatgacaaccttggtgaaagcaagaccacagggcctatcttcagggaagtgccttgcattttaataccaaccatgccacgtgtatgtgtttcctgg

SEQ ID NO: 31167 - DNA, 201 bp, Homo sapiens
cactgctaagttttgatgccaaagagccaaatttgcagtaccagaatgtcctttccatgtgtgacccaaagttttggctactgaagacgttgcatgccctmcaacagtggaagtggtgccctgaatacgccagaaataatcgtggagtcaacgaagatctgggagtattgtttggagacatctcagtattcctaattcatt

SEQ ID NO: 31168 - DNA, 201 bp, Homo sapiens
gtaaatgtgatggcagaactgcctcggaattgccactgtgggtactctgcatgtggggtagccctgttttgcaaggagcagcacctctgctcctgttgtayactgtcccttcaataaaagttgctaacaccaccaccttgcccttgaattctttcctgggcaaagccaagaaccctgttggcctaagccgcagttctgggg

SEQ ID NO: 31169 - DNA, 201 bp, Homo sapiens
cccaatctctccaaaaagtttaaaaatcggctgggcatggtggtacatgcctgtagtcctagctactcaggagactgaggcaggaggatcacttgagcctsgtaggtcgaggctgcagtgaactaagatgccacaggactatagcctgggcagttttgagtgctgcctctaccatgtaactagcttgccagtcaagtcatt

SEQ ID NO: 31170 - DNA, 201 bp, Homo sapiens
acaactaatgtgacatggcagtgtataagacattacagccaaggccttctggttgaagttggggaactgtgggcgttgtccccactagtcctgtcatctgmccttgcaaaaccacccttgggctctctcgcgtgcggtctgtgcaccagctacctttgtgctccccacattcttccacctggcctggaagctgaccatagt

SEQ ID NO: 31171 - DNA, 201 bp, Homo sapiens
gcattcagacatttagaaaatattgcaggcagagctggggattccgtggccagagcatatttggtgaaccgaggacgcatcaaagagcttctctggtgttyagtaacttgcactgtatttcagaggtttataaagggaagggacaggaaagcagtgtgccagtaagacaactcctcttctcgtctggattttagaggaatg

SEQ ID NO: 31172 - DNA, 201 bp, Homo sapiens
cagcgcaagatccaaaaagacaagtgctcagtcattttgtcataatgccagaagagacagtaatgctgtgtggactatgcattcagacatttagaaaataytgcaggcagagctggggattccgtggccagagcatatttggtgaaccgaggacgcatcaaagagcttctctggtgttcagtaacttgcactgtatttcag

SEQ ID NO: 31173 - DNA, 201 bp, Homo sapiens
actaggtagggtaaataataggtcttagatataggtgcaaataattttcaaatatgggtaaatgctattgggatgtgtaaagtagaaatccattttaaagygttattgaatccatactaacctgatcattacatatttactaattgatgattactaaaaatgtggacctttgtgaatttccgatgtcatagaagggtgttc

SEQ ID NO: 31174 - DNA, 201 bp, Homo sapiens
aagagcagtcattcacccctttggactatggatccctttgcaacccaggaacaactactgtatggccacttcaaacctgtatatgctgcaagtattttatwctaggtagggtaaataataggtcttagatataggtgcaaataattttcaaatatgggtaaatgctattgggatgtgtaaagtagaaatccattttaaagc

SEQ ID NO: 31175 - DNA, 201 bp, Homo sapiens
tcttttaacccctctgaatatgctcctcctgtgatacccatagggaccctgaacctctagtcctcaagagcagtcattcacccctttggactatggatccstttgcaacccaggaacaactactgtatggccacttcaaacctgtatatgctgcaagtattttatactaggtagggtaaataataggtcttagatataggt

SEQ ID NO: 31176 - DNA, 201 bp, Homo sapiens
tcaaccccactcctcaatttttggcacccatgttattccacctcaagatcatgtcctcttttaacccctctgaatatgctcctcctgtgatacccataggkaccctgaacctctagtcctcaagagcagtcattcacccctttggactatggatccctttgcaacccaggaacaactactgtatggccacttcaaacctgt

SEQ ID NO: 31177 - DNA, 201 bp, Homo sapiens
atttaaactgaaatgaattaaagttgtataacatttgtaaaaatcacttcttcggtttcattaactagcctcatttcaagtgctcagtagctacatgtacstaacacattggacagcacggttacagaacgttttcatttcatcggacagtttaactgctttggagactggttctcctttttctttttccatgttcactcc

SEQ ID NO: 31178 - DNA, 201 bp, Homo sapiens
gtctgatacggtagccattagccacatgtggctatttaaactgaaatgaattaaagttgtataacatttgtaaaaatcacttcttcggtttcattaactarcctcatttcaagtgctcagtagctacatgtacctaacacattggacagcacggttacagaacgttttcatttcatcggacagtttaactgctttggagac

SEQ ID NO: 31179 - DNA, 201 bp, Homo sapiens
gggcgccagcctgtaatgggcatcagctgattctcagaaagaagaaacaacgtactgttacataattggggcttctccaaagtggcctgaccaaactgtaragctgcttgtttgtctgatacggtagccattagccacatgtggctatttaaactgaaatgaattaaagttgtataacatttgtaaaaatcacttcttcgg

SEQ ID NO: 31180 - DNA, 201 bp, Homo sapiens
gacccaccccaaccaggtttgcagtgagaggaaatagaccccacctcttctggaagagaatgtgggactggacatactgccatggccacttttgaaagatrcagtctgccacataagcaaacagttcgtgtcctgcagtgggatattgggaaaagaatggtatttggcaaggggtcaggaaacctgcttttgaatcctacc

SEQ ID NO: 31181 - DNA, 201 bp, Homo sapiens
agccatgacagtattacgggttttaaaagccacccaagtaatctaaatttcctccaaactaacaattcctgaaagattgaaatattgctaccaatgtgtayggatggtttccattgatatttgggaagtttccatttgtatttgggaagctttgcatgagcaaaatgcccctttctcctgatatttgcaacccatcttaaa

SEQ ID NO: 31182 - DNA, 201 bp, Homo sapiens
tgtagccatgacagtattacgggttttaaaagccacccaagtaatctaaatttcctccaaactaacaattcctgaaagattgaaatattgctaccaatgtstacggatggtttccattgatatttgggaagtttccatttgtatttgggaagctttgcatgagcaaaatgcccctttctcctgatatttgcaacccatctt

SEQ ID NO: 31183 - DNA, 201 bp, Homo sapiens
ccccacattaacaatttctctccttaactttgtttctgaatgaagttatccacagagttttaaagtgagtggtgagttgtggatacctcttccgagcaggwgcacccccatcctgccattgtccctctccttagtgtatatggattgatgacatttcagtttcagacaaagggacatttcattttttttaggagattaaag

SEQ ID NO: 31184 - DNA, 201 bp, Homo sapiens
aataggaagattcgtccagtctcaaggaactatgataagtagcaaacaatatcccagaaaaatctccagtcaaaaatccactggaggccaggtgcgttagstcatgcctgtaatcccaacactttgggaggtcgaggcaggaggatctcttgaggctaggagctcgagaacagtctgggcaacatagcaagtctctgtctc

SEQ ID NO: 31185 - DNA, 201 bp, Homo sapiens
tattcctgagcttccatgtgcttatttgaaaaataggaagattcgtccagtctcaaggaactatgataagtagcaaacaatatcccagaaaaatctccagkcaaaaatccactggaggccaggtgcgttagctcatgcctgtaatcccaacactttgggaggtcgaggcaggaggatctcttgaggctaggagctcgagaa

SEQ ID NO: 31186 - DNA, 201 bp, Homo sapiens
gcatcttgggaagtctgtaagtaatgggagttggaggcttaacactgatctttgagctggcgatttttccagccaactcattttggacgttggtgcttaascatatcctgttttcgagggtggtgttggtggtggaggaggtgatggtgatgatattgataatgacagcaagaatgtcttacatttatagagtgttcaaaa

SEQ ID NO: 31187 - DNA, 201 bp, Homo sapiens
caaatcatatggtcgtgctccagggtgaggaagtatgtcccacttacagactgaaaaggtgctgcaagtctgcacggcagagggcatggataaggggttcrtaaaaacttagggccatttaatacaaatttgtcacatcacactggcttggattgattttgattcattgctctgtcgcccaaacagaattataattatttt

SEQ ID NO: 31188 - DNA, 201 bp, Homo sapiens
cagaaaaaaacaggcagaaacataaaaagctcggagatggcttcctattgcttcttcattctgggccagagcaaatcatatggtcgtgctccagggtgagsaagtatgtcccacttacagactgaaaaggtgctgcaagtctgcacggcagagggcatggataaggggttcgtaaaaacttagggccatttaatacaaatt

SEQ ID NO: 31189 - DNA, 201 bp, Homo sapiens
ttgctctgctcatctttctcacgagtctggcaatggggctgggaatgggctgatctaggctggacttggctggagtaacccagccccaccttggatctctstcctctacttcccacatgtatccttttcatggttaaaggtagaaacagaaaaaaacaggcagaaacataaaaagctcggagatggcttcctattgcttct

SEQ ID NO: 31190 - DNA, 201 bp, Homo sapiens
ggtgaccttggctaagctcccctgcattgctctgctcatctttctcacgagtctggcaatggggctgggaatgggctgatctaggctggacttggctggartaacccagccccaccttggatctctctcctctacttcccacatgtatccttttcatggttaaaggtagaaacagaaaaaaacaggcagaaacataaaaag

SEQ ID NO: 31191 - DNA, 201 bp, Homo sapiens
tttttctccacccaggagccctcaggccgctggtgagtgaagttcttacccattagggattattaatatactagataagagtacagtctctggagctaggyttgtgactttgaacaaattattttatctctctgagctcagtctcctcatctacaaagggggaattgataataggaattgtcgcaaagagctgttttaaag

SEQ ID NO: 31192 - DNA, 201 bp, Homo sapiens
aggtcagtcagtggccatcactactctaaacgtaagaccctgtgatgactgacacttactaggtttctcatttatttatttttctctgcaggacacagctrtgtgttccaaagatggtcttaaacctataggagtataacaccatggctagttcagaaaaccttattccaacttccaaacttagaagatactgggaagtaa

SEQ ID NO: 31193 - DNA, 201 bp, Homo sapiens
cttctggtagaggcgttgaacactagggtgagggctttgctctgacttcaggaagcaggtgagaggccctgaaatttccacgtaagattcggggccgggcrcggtggctcatacttataatcccagcactttgggaggctgaggcgggtggaccacctgaggtcaggagttcgagaccagcctggccaacatggtgaaacc

SEQ ID NO: 31194 - DNA, 201 bp, Homo sapiens
attgttgctcatagcaaaggtttgttgagtttactacggatataacacttgttcttttttaaaataacttttaaaaacgcaagtgttgaattatctgcatkgtgcctttagggcatacacatctgcttacaatattttttgagctttcagaaaacttaagatatggttgagggatgcaggaaggaacaggacaagaaccca

SEQ ID NO: 31195 - DNA, 201 bp, Homo sapiens
gcacagtgtcttgaacacggtaaacaacttacctaggtctgatctcatttgatattgttgctcatagcaaaggtttgttgagtttactacggatataacasttgttcttttttaaaataacttttaaaaacgcaagtgttgaattatctgcattgtgcctttagggcatacacatctgcttacaatattttttgagctttc

SEQ ID NO: 31196 - DNA, 201 bp, Homo sapiens
caaagtttctagcacagtgtcttgaacacggtaaacaacttacctaggtctgatctcatttgatattgttgctcatagcaaaggtttgttgagtttactayggatataacacttgttcttttttaaaataacttttaaaaacgcaagtgttgaattatctgcattgtgcctttagggcatacacatctgcttacaatattt

SEQ ID NO: 31197 - DNA, 201 bp, Homo sapiens
atgctgctatggtttgattcctggctttccaacattacctttgataaccaagacaagtggcagtctaagcctcagtttcctcatctgcaaaatgggtgcamttctagtacctccttcctaaggctgtgaggattcaatgaggtactgcttgcaaagtttctagcacagtgtcttgaacacggtaaacaacttacctaggtc

SEQ ID NO: 31198 - DNA, 201 bp, Homo sapiens
gcctcctcctccaggcttacttggaagcattctgtcctcttgttggaagggaaattggtatggtagggaggtgcttcttctgggagtgggtttgtaaaatyaagactgttttcatccaaaccagttacctgtttgtctagaacctgtgttctctgctttctgcctcttgtgttgacatttctcctttggccttcatctgtt

SEQ ID NO: 31199 - DNA, 201 bp, Homo sapiens
ctgggatacatgttgggcctctgcccagatcatgcttggagtggcaccagctgggtaggacatgtgaaatatttgctcagagagatccagaagtgttgatvtgagtaggatcagctggtgctccaggataaaaatcgtgtcaccacttttgccgaaaagtcactgtgtttctcctgtactcagcaggttacagggtgccat

SEQ ID NO: 31200 - DNA, 201 bp, Homo sapiens
gctgggatacatgttgggcctctgcccagatcatgcttggagtggcaccagctgggtaggacatgtgaaatatttgctcagagagatccagaagtgttgakctgagtaggatcagctggtgctccaggataaaaatcgtgtcaccacttttgccgaaaagtcactgtgtttctcctgtactcagcaggttacagggtgcca

SEQ ID NO: 31201 - DNA, 201 bp, Homo sapiens
ttgtgggctgggatacatgttgggcctctgcccagatcatgcttggagtggcaccagctgggtaggacatgtgaaatatttgctcagagagatccagaagkgttgatctgagtaggatcagctggtgctccaggataaaaatcgtgtcaccacttttgccgaaaagtcactgtgtttctcctgtactcagcaggttacagg

SEQ ID NO: 31202 - DNA, 201 bp, Homo sapiens
tgagctgaagaagccccactctccctctgccccacatctattgtgggctgggatacatgttgggcctctgcccagatcatgcttggagtggcaccagctgsgtaggacatgtgaaatatttgctcagagagatccagaagtgttgatctgagtaggatcagctggtgctccaggataaaaatcgtgtcaccacttttgccg

SEQ ID NO: 31203 - DNA, 201 bp, Homo sapiens
cacatcttctgacctcaagtagtttatagtccaaaaagacattggctctttgggatagaggcactttttgggggagagaaacatgaatgcaactttttacrtagagtatgaaactctgttccaaatctctcaaactcaggttctttgattcttaaggtatttttcactgccgagttgctgtcattgaaacaaaatctgtcc

SEQ ID NO: 31204 - DNA, 201 bp, Homo sapiens
gagtcgaatagacattaagtgagccttccttatgtgctcagcctgtggtgaggctgcaaagacaatacgacccagcccctgtaatgcaaaattcagagcayagggcagcacactgctgccatgagtcgaggtgacacagtactaacagtgggcacagggggctcggggcacagaggaggggtgcttcccagggagactgcc

SEQ ID NO: 31205 - DNA, 201 bp, Homo sapiens
cagctgtgtcttaagactgtgccctttcatccaccctcttggtactcaaagcttggtccatgaaccagcagcttcagcatctgctgagagcttgctggagrtacagaatctcaggcctgactgacccgaggcctgctgagtctgaattttaaccagagtctcttggtgactcgtgtgtactttagaaggggaactgctcac

SEQ ID NO: 31206 - DNA, 201 bp, Homo sapiens
aagatgcgatttgggtggggacagagccaaaccatattacaggctaatgactgagcgggggctgtttcttgttgtgttcttataagaactattgcattttstttttcttccaaatatagttaatggcctcatcttttctggactaggtttgtagtagaccataagcaaaagagttcagaaagcacggcctccaagaagtcg

SEQ ID NO: 31207 - DNA, 201 bp, Homo sapiens
tctttggagctcacagccaagtcctacagtcagcatcagacggcttgtctcaagctgctgatttccgggagcaaagctgctgtgggacatgagactctttsaggcagaatacctctcatgcctggagagcattacaggctgcattagtctgttttcactctgctgataaagacatacccaagactgtgcaatttacaaaag

SEQ ID NO: 31208 - DNA, 201 bp, Homo sapiens
gtgtctcccctccaagaacaggtacttgcccttgtctttggagctcacagccaagtcctacagtcagcatcagacggcttgtctcaagctgctgatttccrggagcaaagctgctgtgggacatgagactctttgaggcagaatacctctcatgcctggagagcattacaggctgcattagtctgttttcactctgctgat

SEQ ID NO: 31209 - DNA, 201 bp, Homo sapiens
caaatgcagaggcttaagacagcacaaatgtcttatcttacagttctgaaggtttcgctccagagtgagttttatggagtgaaaatcaaaatgttggcagkccttaggggagagtccattcctttcatcttccagtctctagaggctgctggcatttttcagctcacggccacagcactctaatctctgctttcactatcc

SEQ ID NO: 31210 - DNA, 201 bp, Homo sapiens
attaccacagattggaagcaggcttcccccaagtgtgtttccctttgtaatgccagtgtcgtaacgccactatctatacttttcaacacaattccaagtgytacctctgcatggcagaaactgtcaaccgtggatggtttctttttagcttgtccttcccgttctacagcatggaggttaagagctctggctttggttcca

SEQ ID NO: 31211 - DNA, 201 bp, Homo sapiens
tggtgattctcagttcttggtagccatgtctcagcatagtcttctcggacacctaatactactgacctgtataatcgatagggtattgcagacatcagagyatgtgacttacgaggctagaccataaaaatattgaggcttctgccttactgatgtggatcattcactctaggaaaagccagctgccatgttgggaggata

SEQ ID NO: 31212 - DNA, 201 bp, Homo sapiens
ttcattggttactgacgctgtgtactgattgggtaaattctagcatttttacactcctttgtttcaccctgtttgttcattcattcttccgttaaactacmattaagcaactaccatatctaattttaaggtggtggacaaagaatcaaacctaagttggggaatgtggcctctggtgattctcagttcttggtagccatg

SEQ ID NO: 31213 - DNA, 201 bp, Homo sapiens
tactgcctctggctaatagggatctttgacacatacgctttttctccctttccagctggccctgttgcttaaagtggcagaagtagatgtcatgttggcasacagttttgttcactgtcaaaactgggtttatctaatgtgtatttgaaacaaacaaaaaaaaatcaataaaatgagcagctttgggagccagggtgaagg

SEQ ID NO: 31214 - DNA, 201 bp, Homo sapiens
cctgagagtggtttagcatttatggagccctgctttgtgctaatgagtttatatgccctgtcttctttaatcttcaccacaactttatgtaataagtagtstccaataaatttaatcacataattacttaaatggcctggcgagccgccttacctagctggccaggaattccaggagtcaggcttcctgatctaaatctgt

SEQ ID NO: 31215 - DNA, 201 bp, Homo sapiens
ggtcctcaaaatagaaggtcagagagtagacttttaaaagtcttgcactgtttacaagtcagatgctttttggcagagtgactctcagctccctccaacartcccttcttgtcgttcagtagtagatagactctatcagggaaaaataggagaaataaaataagacagcatatggaaggcattgctgaaagtctttttcac

SEQ ID NO: 31216 - DNA, 201 bp, Homo sapiens
ggaaagtctttcactcatttctatctgcagtatttactgggcatttttccacgccaagccctggggatacagagttaaataaaatagaagcttaatccagrcatgctggctgtaaagttcacctttcggctcctttctgccattcttattagggtcttgccccatcttggcagcaagcctgctttaccattggagacctca

SEQ ID NO: 31217 - DNA, 201 bp, Homo sapiens
cttgattagttcttcctgttggtggactgattgattacatttgaatctttcagcaagcttttggctgagctgggcatcttccccgccttcctccacctctsccttcaaaagcctgaatttccaaggctttctgccatgagtacttagctttgaaaaacatgagcatatttttcattcttcttgccggcctctccctgtgtc

SEQ ID NO: 31218 - DNA, 201 bp, Homo sapiens
aagaaatggagatctcaagaggtaaaaaaaactgactataggagccaagactagtttagagtggagtttgaatatgaacatgcctctgtctgtgaaagccmgtgtcccttcagccaggatctttcctggaagaactcagtattaaggcacttgattagttcttcctgttggtggactgattgattacatttgaatctttca

SEQ ID NO: 31219 - DNA, 201 bp, Homo sapiens
aggattcggtgtctaccctcaagaagcatcatttagagaagaaattagaaaagtaagtgaggcagaacaggatctggaggcagggaatctaaggctgattsacgttgactttgtataattaaatcaaaaggaaaacaccaactttccacaactaagttataaaaggaccagaggctactccctctgcaacccctccccact

SEQ ID NO: 31220 - DNA, 201 bp, Homo sapiens
gatgctggtcaggcgcggtggctcacgcctgtaatcccagcattttgggaggccaaggtgggcagattacttgaggtcaggagatcgagatcagccgggcyaacctggtgagatcccatctctactaataatacaaaaaatagctggcgtggtggcgcatgtctgtaattacagttactcgggaggctgaggcaggagaat

SEQ ID NO: 31221 - DNA, 201 bp, Homo sapiens
gccatgggtctcctaagtgggatacaccacgatgatccactggggcagtggccagcaaagtccctgtccagccagccactcgtttttatcaataaattttyactgaaacacagtcatgcctgttaggttaggaactgcctagcgccacttcacactgcagtaggagagtgagtagttgtgacagagaccatttatcccaca

SEQ ID NO: 31222 - DNA, 201 bp, Homo sapiens
ggcagctgcccacttccagaaagctagaggttctaattatgtcttcctgaaaaacagttcaattaggtaaagtgacattttttaagcccttgtgtgtgtcygactcataaaagttcagaaggttgttactgagaggagactgcagtcattttaagatttcagtagctgctggagttgagtagataatttttcccctttcta

SEQ ID NO: 31223 - DNA, 201 bp, Homo sapiens
tcttgggacaaatgtgtgacaggtgaggaaaacaacataggaaaggagacagaagtgaagagaagatgtggtctcaaatgaagtctggcttcaggtttatycttggggggctctggaataaaaatcacacctcaaacttgacccgcttgaggccagaaggccgggctgtggtaccttcgtgtcggacagtcataggctatc

SEQ ID NO: 31224 - DNA, 201 bp, Homo sapiens
agacagcagacagttcctctccctgctgctggcctcttcatcttctcctggcgtcaccacggccaccgtgatgcctggctcaagtactagttctatgtcartgatggtaccaatggactctaactttagaatgttgttgactgaaggcccctgccccctgccttgctttaggtggaggatctggtcaaggctttgtgaatc

SEQ ID NO: 31225 - DNA, 201 bp, Homo sapiens
caagtcaactttttgtgtctgcaggcatgggcctgccctgtacatgaggagacagcagacagttcctctccctgctgctggcctcttcatcttctcctggmgtcaccacggccaccgtgatgcctggctcaagtactagttctatgtcaatgatggtaccaatggactctaactttagaatgttgttgactgaaggcccct

SEQ ID NO: 31226 - DNA, 201 bp, Homo sapiens
agcctctgttctttcttgtttccctttgttaattcctttttcctttcattccttcttatctatccctttcttaccttctttatttcctcgtttatttgggytttttcggttgtgaagatcagtaccttgaaattcagaatagatggcatgaagcacttcagctttgcattcaagtactcatgtgtatgatcaagcatcgtc

SEQ ID NO: 31227 - DNA, 201 bp, Homo sapiens
gaaatacaaaaattagctgggtttggtgacaaacgcatgtaatcccagctgctagggaggctgaggcaggagaatcacttcaacccggaaggcggaggttkcagtgagctgagatccagcctgggtgacagagcaagactccatctcaaagcgaaacaaaacaaatgagggtcctcatcagcgtgcctttgacactgtcct

SEQ ID NO: 31228 - DNA, 201 bp, Homo sapiens
ccaatgtgcttttcctttttcctgagagcagccctctacatcttccgtggtgtaagttgccttattccagcacgtggcatcgccagtcccagtgcccttgrcagaccatgcagaatgcatccatggaatatgaaaaatgaggcccagtggggcacagtggctcacacctataatgccagcactttgggaggccaaggtggg

SEQ ID NO: 31229 - DNA, 201 bp, Homo sapiens
tctgcacagtgctgagcttttgtgtttttggtcatcccaatgtgcttttcctttttcctgagagcagccctctacatcttccgtggtgtaagttgccttaytccagcacgtggcatcgccagtcccagtgcccttggcagaccatgcagaatgcatccatggaatatgaaaaatgaggcccagtggggcacagtggctcac

SEQ ID NO: 31230 - DNA, 201 bp, Homo sapiens; identical to SEQ ID NO: 8620

SEQ ID NO: 31231 - DNA, 201 bp, Homo sapiens; identical to SEQ ID NO: 8621

SEQ ID NO: 31232 - DNA, 201 bp, Homo sapiens; identical to SEQ ID NO: 8622

SEQ ID NO: 31233 - DNA, 201 bp, Homo sapiens; identical to SEQ ID NO: 8623

SEQ ID NO: 31234 - DNA, 201 bp, Homo sapiens; identical to SEQ ID NO: 14861

SEQ ID NO: 31235 - DNA, 201 bp, Homo sapiens; identical to SEQ ID NO: 14862

SEQ ID NO: 31236 - DNA, 201 bp, Homo sapiens
agaaaggaatacactttggctttacaaaactgcttattttcaaatttttaaatggggacaaaaacgaatatgctatattatatacttttatttatataatwtttttttcagcaactttttctcttttgaaaatgcaagagcctgaaaaacattgtgaatatacttgtaacattgcaaagctatttcaccagagtaaagata

SEQ ID NO: 31237 - DNA, 201 bp, Homo sapiens
agtgggccccagttctttcaggtttaaggaataagcattttggtctatgaaaaatggggtttgcctaaagtataagattgtcttatatttataaatgcctstgttcattgctgtgggttcactgctttctcttttgggcagccatataaataaaagaaccacctacttggacccaagactggcgtttactgtggatgataa

SEQ ID NO: 31238 - DNA, 201 bp, Homo sapiens
ttatagctacatttacatgaattacataaaagcccaaaaccttctcaagaagccttttttgagatctaaggatacatggcaatagttattgtatgttacarcgtatgttataggcagttctgaaggaaaggattcgatgactatctttttttggcacaaatgtgatccttctggaggccagaagatagattcagtgggccc

SEQ ID NO: 31239 - DNA, 201 bp, Homo sapiens
tacctcttgtagcacctggctgtttcccttttgaaataattgtatgttttcctggataccttattacctggtgacacgtgtttctagttattgacctatgwttttaattataactttgggtggtggtctgaaatgaaatgttaagtttgacgcaaaaataggactagtttgtgtaactgatttgttcagaataacagctta

SEQ ID NO: 31240 - DNA, 201 bp, Homo sapiens
gttcacatcttatcatctagatgttgctgattaaataatataactttctgggttggcatgagtaggtgaacttttaggaaacgcagcctacccttcgaatrcctcttgtagcacctggctgtttcccttttgaaataattgtatgttttcctggataccttattacctggtgacacgtgtttctagttattgacctatgtt

SEQ ID NO: 31241 - DNA, 201 bp, Homo sapiens
cttggctgtgtactcctccttgttggccctgtctcccttgcccaggttgcagatgtcatggggcagcttgttcatctgagtgtccccagtgcttggcaccyagaagccataagatgagcccctgtgggatgagtaaatgaatcaccttgggagggtcagccgcaggcttctgtgggtgggtgggtggtgcactgggcccca

SEQ ID NO: 31242 - DNA, 201 bp, Homo sapiens
gcagagccagagagtggcattcattcagcttgtgaattctggaagaatttctggctctggagaattaaagggacatttccagcagcagagctccagtagcytttgcagggacggaggcaagctcctgagcgggcacttgctgttcctctcacctgtacatctgttggggaaaggctccttctcatccttcagagctgagct

SEQ ID NO: 31243 - DNA, 201 bp, Homo sapiens; identical to SEQ ID NO: 8624

SEQ ID NO: 31244 - DNA, 201 bp, Homo sapiens; identical to SEQ ID NO: 8625

SEQ ID NO: 31245 - DNA, 201 bp, Homo sapiens; identical to SEQ ID NO: 8626

SEQ ID NO: 31246 - DNA, 201 bp, Homo sapiens; identical to SEQ ID NO: 8627

SEQ ID NO: 31247 - DNA, 201 bp, Homo sapiens; identical to SEQ ID NO: 8628

SEQ ID NO: 31248 - DNA, 201 bp, Homo sapiens
cacagaagagagaattacttgtctaatatataatttcaggcataaggagaaggtgatattgcattgcaaataatagcagttagtgggagttgagagccagstctgcaccagactcgtatcagccacttgacctccattattccttattccttggtacctctgcgccatctgtgatatcagatccttttttctgcaaggaaa

SEQ ID NO: 31249 - DNA, 201 bp, Homo sapiens; identical to SEQ ID NO: 8629

SEQ ID NO: 31250 - DNA, 201 bp, Homo sapiens
gcccaggctgtaggagatgtcatcagggcctgcagagggcaaaacctcacagaggcttctgttcatacattgttgtacctcatgtgtgcgtcatattgtcrtatatcaatggcagtagccaagaccaacagccaagaccaatgtattctgcccacaggaaagtgaggcaaaggcagggagggaatgataattgtgaacaaa

SEQ ID NO: 31251 - DNA, 201 bp, Homo sapiens
tggaattaacatagatttcccacatggggaaggttttgggtgaggatttagaacaaggcaggttcttgatcctcggaagagattcttatctgaggggggawttgagaatggcattgcagagtgggaggcgctgctgtgtggaaaaatgaactggaataattattagaacagttctcagaatttacaggatatttgatcata

SEQ ID NO: 31252 - DNA, 201 bp, Homo sapiens; identical to SEQ ID NO: 8630

SEQ ID NO: 31253 - DNA, 201 bp, Homo sapiens
cataggtaggaaaggtaaaaaaacataaatctgccaatagaaaatagcatcgtaatgagtttctactatatttgtttgggctttgaaaaatatgccgccamaatatatcaatgtatggtcccaacgttttaggaagttgcatttaaaaaatcttggatacctgttttgtacatattatatatagcatcccgtgtgaatatg

SEQ ID NO: 31254 - DNA, 201 bp, Homo sapiens
tccacctgggcacccagcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttg

SEQ ID NO: 31255 - DNA, 201 bp, Homo sapiens; identical to SEQ ID NO: 8631

SEQ ID NO: 31256 - DNA, 201 bp, Homo sapiens
tttgtgtcattttcaaacaaagcatcctcgctgcagtgttggattttgtaggatggtgaccgtttacagaaacctctggtccgtgagccaatttggagaawattgaatcattctctgtgcctttcggcttgcatcctaaaagcctgcacaaacactttgggcaggcttcagcaacttcacatcaagggctcaattgcagct

SEQ ID NO: 31257 - DNA, 201 bp, Homo sapiens
cttggggatgatgacagtatttggatcacaagattgttgtgaagatgaactgaagtgctaatgtgaaatgttcatgatggtacccgagtacttgcggtggyacctagcgtgtgctttccaagtgctggcaaagaaaagaaaagaattgcttggggctctgcctacctgtctaggctcctgtctggccattctctttcttgt

SEQ ID NO: 31258 - DNA, 201 bp, Homo sapiens
ttttagagatagtatatattttagatgtataagtggataaactggaggtatggaaggtctttatttaaggagaataaatagcccaccccatcaacatgatrgcccttggaaaggactcttttagcctccgcgagttccttttccgcaccaggctccacttacgaaggactgcaaaaacttgctaacgtcatcagtctgaaa

SEQ ID NO: 31259 - DNA, 201 bp, Homo sapiens
catccacggagcctcaaaggctaaaaataatcatccctttcaatagttcctgttgtgaggaccattaacaaattataagagaaagcattcctcacttgtakaaactccatgaaaacagacatgtgtttacttatctgcaaccctgtgttaggaggagggtgatgagacactttactgtttgaatcaggaagtgctgacagt

SEQ ID NO: 31260 - DNA, 201 bp, Homo sapiens; identical to SEQ ID NO: 8632

SEQ ID NO: 31261 - DNA, 201 bp, Homo sapiens
tgtgttggggggaggcatgtggtatgtggggcgggtaaaatacgagcctcatgcctgtctaagctggtgacttggcttggaaaagatgatcattcgtcaaygcatcacaagtcacagggcttatctccattgttctgaacgatctgtagctaaacaaaaagataaaagctattaatattattaatagttgtagattaccgg

SEQ ID NO: 31262 - DNA, 201 bp, Homo sapiens; identical to SEQ ID NO: 8633

SEQ ID NO: 31263 - DNA, 201 bp, Homo sapiens
ccccattcatatttaaataaagaaaacggggcagtggggcttgttcctatgttgtggaacagcacacagatgtgatctacctcattcacatccttatgtgmattatacactggtgccctcacctcttaagacaagcacctatcgttttcctgtgtattccaagaggccagtgtggctggtggaataagatgttttcctgtt

SEQ ID NO: 31264 - DNA, 201 bp, Homo sapiens; identical to SEQ ID NO: 14863

SEQ ID NO: 31265 - DNA, 201 bp, Homo sapiens; identical to SEQ ID NO: 14864

SEQ ID NO: 31266 - DNA, 201 bp, Homo sapiens; identical to SEQ ID NO: 8634

SEQ ID NO: 31267 - DNA, 201 bp, Homo sapiens
gtgaaaatgctggggatctgcgaaacattaaagttaatggccagaataaggctgccaagctcggtggaattgtacttaactggcatatcattctggttaaytgaactttccattaactcacagatctatcttttcatgcccccttctaaccccctactcaccacccacccagttcctcctagtgggcagtttgctgctgct

SEQ ID NO: 31268 - DNA, 201 bp, Homo sapiens
ttgtaaaccaaggtgaggacttaagattttattctagctgcagtgaggaaccagtgagtggttttaagccagagagagattgataagacatggaatgatayggtgtgatatatgaaatgacatgtttgaaatgatagatgacgtgattgtgatataatatcatgcggctgaggacaacactataactgctcggtagagaat

SEQ ID NO: 31269 - DNA, 201 bp, Homo sapiens
tttcctctcccccttacaagggacatttatgctttctccctctacaaaacctgcatgcaaattatctgatggaattgacccatagtgggtgttctccactrgttcaacacacctgaattccggattcaagatgcaatcaccactactgttgttgtgtaagtattgctagagatggctgcagaatacctgggaaagctagct

SEQ ID NO: 31270 - DNA, 201 bp, Homo sapiens
acttaaaagtgtggaagcagagtgtcccaggcggaggaaacggtaaatgagacctctggtagtaagaagcagtgtagcatgtttgagacactgaagtccartggaacttgggcggaataaatgaagggaagattcaaggtgaaggctgagaggtgtgcatgggtctgatcacacagagccttgtaaaccaaggtgaggact

SEQ ID NO: 31271 - DNA, 201 bp, Homo sapiens
agttacctcccaccgagtccctcccatgatacgtggggatgatgggagatacaattcaagatgagattttggtggggacacagacacaccatatcatgtcytggcagccatctatattcaagacactattctaggtatgacataaaggatggcaaaaagtcagttacttaaaagtgtggaagcagagtgtcccaggcggag

SEQ ID NO: 31272 - DNA, 201 bp, Homo sapiens
tcaaccgcaacacaaatcttatatcattagatttcagtgatattgaatgtgggagatggaaccattttagtgcatttgatatgatgtgatgtggctttctscaagcctgagagtgcctgaaacccagagaggtcgtacgttgaccatgccacggggcccttcctggtaaatctaagcagaaatacaccatgcatgagacag

SEQ ID NO: 31273 - DNA, 201 bp, Homo sapiens
gttacagtgcttaggaagtgttagatgtactgtcatttcttcaacatatatgtcctatattagtctattctcacactgctagtgaagacatacctgagatkgggtaatttgtaaaagaaagaagtttaacggactcatagttgcacatggctggggaggccacacgatcatggcggaaggcaaaggaggagcaaaggggcg

SEQ ID NO: 31274 - DNA, 201 bp, Homo sapiens
tgacactgcatttggggggaaggtaagggaactggggaaaagaaggcaaaatgatgacttaaagagactgatgaacccaaagctctcttgtgaagcccctkctagaataagtccgtctcacgttacagtgcttaggaagtgttagatgtactgtcatttcttcaacatatatgtcctatattagtctattctcacactgct

SEQ ID NO: 31275 - DNA, 201 bp, Homo sapiens
tggctctgtctccaattggctacgagggcttgtgtgtactctagttctctttccgtgacactgcatttggggggaaggtaagggaactggggaaaagaagrcaaaatgatgacttaaagagactgatgaacccaaagctctcttgtgaagccccttctagaataagtccgtctcacgttacagtgcttaggaagtgttaga

SEQ ID NO: 31276 - DNA, 201 bp, Homo sapiens
ctttccatctccctgatcagaaccattctgcgttcttagattcaacaaaatgtaatactccaccttgccagtatctagcgtgttttcagaaattgtgaacrgggtggaggtggagtactaactgcaatcagatgttttatttgtttatttatttttccttcttgcgttgctcttaagcccccactcttgggcaaggctctg

SEQ ID NO: 31277 - DNA, 201 bp, Homo sapiens
gctttgtttattttagccggtgcctttgtagagggaaaacagcttagcaagcatttagtaggtagatccaaagtccccaggagctgttgggaagtccatasgtgctgtttccattgctttttcattccttcatatattaatcaaggagtcagtcaatcaattaaacggatactattagcacctactgtgtgccgggcactg

SEQ ID NO: 31278 - DNA, 201 bp, Homo sapiens
agcttacattttgtcatgagtaaaactgaaacagtaattcccatgtgctgagtttgctgtgaggattaaagacaaggactgttctaagcccggcatataaygggagcccattataagtgaactgaggtgttattttaatatataccttttaaagtttgagtgttaggcatgctgttgagtgaaagaagacagactgttacc

SEQ ID NO: 31279 - DNA, 201 bp, Homo sapiens
taagcagtcccatcacgaacaaattgccaaatgcaaggcctgagcaaaagacacagaaaggatttctttatcgtaagcacacttctctacattacctttayaatccaacaactctgctattagtaaattatagaaacaacttttgtaacactatcttgtttgcagagtatatgaaaaatttgaagttaaaattcagctcca

SEQ ID NO: 31280 - DNA, 201 bp, Homo sapiens
gtcggggagaaaaggacaaagtttttctcccgcaactgggccaccaaaccagcagagcctccagccagggtggtctcgaggaggcccattaccggctggastgacagagtgtgtcaagcctgcagctcgtcccgtgtctaatggaacagaaacaagcaccctgctgcccttgttttccagtggctcaccggggctctgcga

SEQ ID NO: 31281 - DNA, 201 bp, Homo sapiens
catgcatatacgtgggtgtacacacacaggtacacacaaatatatatgtgcctttggacaaaaaaaaatccccaggacagtctcatttggcttttaaaatrctgcagttgaataggaccgtagaggtggcctaaggcagccttccattcagggcacgcagatttggttcctcagctcccttcttctctatttctgagtcac

SEQ ID NO: 31282 - DNA, 201 bp, Homo sapiens
gctttgggagttcttgttaaccctgacaattcttgtcaaatatcttactcctgggctgtgctggggatggcagcagagtggggtggttggatgggaaggcrggaaagagctagcttggagatgatacgcttttccatccttgaataacttgggaaaaagtcaggagtgtggaatgaagaattggaatataaaggctgaggg

SEQ ID NO: 31283 - DNA, 201 bp, Homo sapiens
acataactcaaagtgcttgctttgggagttcttgttaaccctgacaattcttgtcaaatatcttactcctgggctgtgctggggatggcagcagagtgggktggttggatgggaaggcgggaaagagctagcttggagatgatacgcttttccatccttgaataacttgggaaaaagtcaggagtgtggaatgaagaattg

SEQ ID NO: 31284 - DNA, 201 bp, Homo sapiens
ctctgcgtggtgtgcaagttgaggcctggtgtatgcacttcggccacgggctttcccactgtaatgaagatggaatgactccatggatgacctttccgtgsctttgtctgtagcctgccctcctctttaactgaacaccttccagacgagcatgctctgaactcctgaactgctcattctgttctctgagagaattgctca

SEQ ID NO: 31285 - DNA, 201 bp, Homo sapiens
gggaggtaatcaggggtgtgctgggagggccagaacgatccacccacgtgttggtgccacccggcaatggaaaagcctctggcctcggccttctccggaasgttgtccgcggtgccagtgagagctgcttttcaccttacagcagccccggcctatctctcaggaggcctgctgataatcagtaaatgaaattcacctttc

SEQ ID NO: 31286 - DNA, 201 bp, Homo sapiens
tcttggactcattttcctcggtggtgaagtggggataatttattgacagtggaccgtgaggttctgcgcacaaaattcgttgcatagcacctgatacacasaaagctttcaggcaaggttagtttcgggtatttccagccttagtcttggctgtgggagccataatggagttgttcagaagtttacagctagtgtttataa

SEQ ID NO: 31287 - DNA, 201 bp, Homo sapiens
ttacatttatcaaatgttgtcctgcccagtactttatattcattgttgcttccggacctagctgacaacatggtctatatgaaaaacaacacaaaacaacrcataagagagtcaaagggacttctttggggagaatataaaaacaagccaaggcgaaagtggctgtaaaaatgcgttgtgttcccaagtggaggctccttc

SEQ ID NO: 31288 - DNA, 201 bp, Homo sapiens
ttgatgatagcattaaaacaaatgcctcaaatcatttttggaaggagacaggatatgaattgacaaattaataaaataaattatacttcaaagatgctaarttatctcttctatgtaagtaggaggctctcttttcagatgtggaatttgtaggagcttgaatattctcaagagagggtatgggcaacatttgataaaaga

SEQ ID NO: 31289 - DNA, 201 bp, Homo sapiens
aatgaaaagaatcaggagtctattgaggagacagaacatgagtgatttctgtgtgctgactatatttaaagacaagattagcagtaatatataaacgtaartaagaatttttttccccagccaagaaccatagattggacttcacattcaaaatgtaaattgtgcctaggaaacatcaatgcttattttaagcaactgacc

SEQ ID NO: 31290 - DNA, 201 bp, Homo sapiens
tacccaagacagagaagaaaaacgaaagagagcctgagcattcctttgactccctccacccccggaaggtatattcagagtctccaagactgcctccgccyactcacatgtttatggcccggtgagaccgcatcctccctttctctatctgtcccttttctggatgcagggacacagaatcccctaagtgggaagagcttt

SEQ ID NO: 31291 - DNA, 201 bp, Homo sapiens
gaagagactggagaaagccaatctgtttctccctgaaaatcatcttacttttttaacgcttcgtacctagatttggcctgggcagcccagggagactgttmgagcactggatacctagactctgctgggctctagagaagtgctgggctacagcgcccagtgccctacctcttggggccagccagcctcaccaaaaaatca

SEQ ID NO: 31292 - DNA, 201 bp, Homo sapiens
ggtccaccaggccctctgagtggggctcaggacactctgagatggaagagactggagaaagccaatctgtttctccctgaaaatcatcttacttttttaaygcttcgtacctagatttggcctgggcagcccagggagactgttcgagcactggatacctagactctgctgggctctagagaagtgctgggctacagcgcc

SEQ ID NO: 31293 - DNA, 201 bp, Homo sapiens
ccaggcagcccccactcttcagaacttcaaatctaaagatcttttaaatacacagaacttacttttgaaagctgtggcccatcccaaatgaattctaatcstcagcctctagaatgcctggagtgagaaaacagaatattgttcttttctgtttatattatttcatactgagttaacacacttgccaagactccgaggcag

SEQ ID NO: 31294 - DNA, 201 bp, Homo sapiens
cattagttcatggattttgtgtctattatgaataatgctgccatgagcatctgtgttgtccacaagtttcagcatggacttctgttttcattccaatatcstttgatgacatgtcttggcagtgatgtctatgacactgggcaagtgtcttaaaatgttgtgcatcagaaaaaagtcatcattgccaaggccagcagatct

SEQ ID NO: 31295 - DNA, 201 bp, Homo sapiens
ccattcattagttcatggattttgtgtctattatgaataatgctgccatgagcatctgtgttgtccacaagtttcagcatggacttctgttttcattccartatcgtttgatgacatgtcttggcagtgatgtctatgacactgggcaagtgtcttaaaatgttgtgcatcagaaaaaagtcatcattgccaaggccagca

SEQ ID NO: 31296 - DNA, 201 bp, Homo sapiens
gctttgcagggcctatctgcccttagccctccaatatccttttcattttctttaatagttttattgatatataatgtgcctaccatataattcatctgctyaaggtgtacaattcaatggcttttagtgtattcagagtttgcatccaccatcacaatcagttttagaacattttcattaacccaagaaaatgacccctta

SEQ ID NO: 31297 - DNA, 201 bp, Homo sapiens
aatctaaaaaatttctgtacagaaaggaagcaatgaacagagtgaagcagcatcctacagaaagagagagaatatttgcaaaccacacatgtgataagggrttaatattcaaaatgtacacacagcgtaaatgcaagaaaagaatctgatgtaaaaatggcccttccaacatctagcattattgtgtgttgaataaatact

SEQ ID NO: 31298 - DNA, 201 bp, Homo sapiens
tgattccagaagtttataataattggaaagtgtattagtcgattctcacactgctataaagacattcctgagactgggcaatttataaagaaggaaggttyagttggctcgtggttctgcagactgtataggcttctgcctctcgggaggcctcaggaaacttacagttatggcagaaggtgaaggggaagcaggtaatgt

SEQ ID NO: 31299 - DNA, 201 bp, Homo sapiens
cgacaggcttacccagttcatttaggcgtggctcgattaatgcacacaaagctttgggaacatatcagtcacatcaagctaggtccacctgtgtgagtaastaacgtgtttatttatgattttctttaacagcacagaagagcaattgcatttggtcattctagtatcaactgagttctttataaaatatctttggggtgt

SEQ ID NO: 31300 - DNA, 201 bp, Homo sapiens
caggtggctagcattatttgggtccagaagcttccctggaaagaaaggattcactgcaagatcgacaggcttacccagttcatttaggcgtggctcgattwatgcacacaaagctttgggaacatatcagtcacatcaagctaggtccacctgtgtgagtaagtaacgtgtttatttatgattttctttaacagcacagaa

SEQ ID NO: 31301 - DNA, 201 bp, Homo sapiens
taagacaggtggctagcattatttgggtccagaagcttccctggaaagaaaggattcactgcaagatcgacaggcttacccagttcatttaggcgtggctygattaatgcacacaaagctttgggaacatatcagtcacatcaagctaggtccacctgtgtgagtaagtaacgtgtttatttatgattttctttaacagca

SEQ ID NO: 31302 - DNA, 201 bp, Homo sapiens
aaaacagcatggatcttcctgcagagaacagactagccccctgtacagcacacaactcggggaattttaggtctggtgatttactgctgttggagcctggmcttcttcctgggagaaggctggaaaaacttcaagtcagttacttaatggaataatacatgtttcctgcttccattgtcttcctggacctgacactcactc

SEQ ID NO: 31303 - DNA, 201 bp, Homo sapiens
gactgaatttatgatgaaactttcttcgtatattggctttgagaaattctgttttggtgcttatgtgctctggataattctcaatgactttcaaagttatrattcagggagtaattggttctgagagaatatgcataatcacatcaaggtgtgtttgttttccaccatttgtagccttttgacaaatttctgggggcctca

SEQ ID NO: 31304 - DNA, 201 bp, Homo sapiens
cagtgtgctggagtcaaacatattcagcatccaatccacattggactgtttgcatgtaacgtacagaacactcattcatctacatctaggaccataacagygagcaggagacagtccctgaccctggggactaagcccaggacctgccactaggagatattcatggaatcactgtttctcctccttttcaaagaagactga

SEQ ID NO: 31305 - DNA, 201 bp, Homo sapiens
acacagggaagcagatagttccattaggtgacagtgtgtgcacagtttatggaggatgaagcggaaaacctgagccacaaggcagtagaggttggacgagrcactcattccgaaggcgggtgtgtatgtgcaaactgtataatttttttcttcttttctatctgctagcaaagtgggtaagttgacccatgacatggtcca

SEQ ID NO: 31306 - DNA, 201 bp, Homo sapiens
taaatgagcaacctggaagatgagtggcgtttccacacacagggaagcagatagttccattaggtgacagtgtgtgcacagtttatggaggatgaagcggraaacctgagccacaaggcagtagaggttggacgagacactcattccgaaggcgggtgtgtatgtgcaaactgtataatttttttcttcttttctatctgc

SEQ ID NO: 31307 - DNA, 201 bp, Homo sapiens
agtaaatgagcaacctggaagatgagtggcgtttccacacacagggaagcagatagttccattaggtgacagtgtgtgcacagtttatggaggatgaagcrgaaaacctgagccacaaggcagtagaggttggacgagacactcattccgaaggcgggtgtgtatgtgcaaactgtataatttttttcttcttttctatct

SEQ ID NO: 31308 - DNA, 201 bp, Homo sapiens
tcaagattctgcagcccagggtgctgcttgttgatggacatcttcacctgactttctccctggtccaggtgcattttaagcatggaaggtgacacttgccrttctcaatggacaaagggagtggggagtgtgggggtgtgctttggggttagtctctgggttttcgaaacttagcattctcagattcccagccaactggtt

SEQ ID NO: 31309 - DNA, 201 bp, Homo sapiens
taccaagtaactttagatgcaaatatggtagtactgtgaagattatggtttttgaatgaagtcactttgtggcatgatggtatagaataagatattttcayagtgaaaatggagataagacatgtcccattccctagaatagactgtcactgctctcgttgcctccaaggaggaaactgttataggaatgattgacatgga

SEQ ID NO: 31310 - DNA, 201 bp, Homo sapiens
acggtttaaaattcccttaaatgatgtttttaaatgtaaataactgagctcatttgatctggttcttccttaagccaatgttagcatgaatggccatattyaccaccccggggttccttttcagactccggaaagaaaaagcgatgataatgacgtatttccctcccttccacaaaacagggccaggtgtaacacactaag

SEQ ID NO: 31311 - DNA, 201 bp, Homo sapiens
gaggacgtcttcttttataacagctctaggtcttgcctgttaagcacgctgtaaaatgactgttacacgtttatggattgaaatggttctgctgaaatttkaagtgttaacattgttcaaattttcattactaacacctctcacattgttagaaaacagttttatgtttgacattttgatcatactaacctgggacatttt

SEQ ID NO: 31312 - DNA, 201 bp, Homo sapiens
atggacaaccaggctgggccatgggttgtgttttttttcctctcattttatagaaatgttaccaggcatattttccctgtttccctaagaagagcttcctstcagtgctagccagccacagggccaagtgacacctagaggtgatcctttggttatttgctaaacagatctaagacaaaccgatatctgtaacctgggatt

SEQ ID NO: 31313 - DNA, 201 bp, Homo sapiens
aaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgc

SEQ ID NO: 31314 - DNA, 201 bp, Homo sapiens
gaagaacatacttcatacaaagctatgaagcatattggaagattttaggtgccctgtcttcctggatataaaatgactccaaactcagtgatactgatcascctggcttcttttccacctttctcacttcattgtctttttgtgtgtttctgacatctgttgacaaatgggcaatcttggggatggggggttccactggta

SEQ ID NO: 31315 - DNA, 201 bp, Homo sapiens
aggaaaaaggggactgaaattagtgctgataaaagcttgaattagacattatagcactgaaacttctttttcttccttacttagaatttggaagaacatayttcatacaaagctatgaagcatattggaagattttaggtgccctgtcttcctggatataaaatgactccaaactcagtgatactgatcaccctggcttct

SEQ ID NO: 31316 - DNA, 201 bp, Homo sapiens
cagagctgctgcctcatttcttacgttgcccccacccgtgcagcaattcttcctgggaggcctcattgttcatattcataaagggccccattcagtctccyttttggagaaatggccactgcaactctctgttctgacctggggggaaatgttagaccctcaataaggagaatcagagaaagaagaaataaaacatattac

SEQ ID NO: 31317 - DNA, 201 bp, Homo sapiens
gttactgtcagttgttgtaaactcgtcctgccgcctggactagttacgcttcccttgattagctctgagaaacgaggcagcgggcactggggcagccacayagacaacatctaaatttttgttgctttcctgggtcttgccctgtccttactgtttcccttgggcacgctgttcaccccttaggacatactacagtaacct

SEQ ID NO: 31318 - DNA, 201 bp, Homo sapiens
atgccttacctcttcagtgtctgcaaatgacagccgccgtgctgagcgctcactgaagtggaaccgggagatcagaggtccgtctccaagtcgcccttagyggaggcaggagcagatgaactgccaagtaggagtaatagagtcataattggtgattagaactggaaaggtgcaataacatcttaatacaaactggcgtat

SEQ ID NO: 31319 - DNA, 201 bp, Homo sapiens
tgtccaatgacctgctgtgtccttgcttttgaagaactaaagagtagacttgaccactttttaaacatgacattcgatccacgtggcatagcaaggatggratccacaagatggagtgatctttacgccatcctcctgaccataaatactaaatgaatactctatttcagttgagtttttagtttgctctgttacgtgagg

SEQ ID NO: 31320 - DNA, 201 bp, Homo sapiens
tttacttccgtcacaaaactacttgaagttgtcccaggctagttggtcctattaattacaacctagagggattctattagtaaactaatggattacagtayctaaatggaagccagcagatgactttggaaggactgatccgcaagggccttctgtgtgaagattaaatgaagcttcctttagccttctcaggtggccaca

SEQ ID NO: 31321 - DNA, 201 bp, Homo sapiens
ggaattagcatgtagaggttggcaaaggggacaggagactgtgggatgattagtatattcttatttggcctgggagggaaaaaaaatctttcatttccaasaatattcattctctgtgtcacctcagcatttaatttacttccgtcacaaaactacttgaagttgtcccaggctagttggtcctattaattacaacctaga

SEQ ID NO: 31322 - DNA, 201 bp, Homo sapiens
catttttaacatagacaccaaaagagaggctggaagagttgaccacttagaaatgtcacgagtgtctgtgaatagtgttgggggctgagaggcaagagaaraaaatagtcctaatgttgtacaagtagcaatggaaacaaacttgttaaaaaaaatttaattttgtttatgcatgtgtgcataaacaaagcaatagaaaat

SEQ ID NO: 31323 - DNA, 201 bp, Homo sapiens
ctatgaaatatcaagctctttttatgcttcttcacatggcaccttgtgtagaatttgaaccactttaaacattgcatccttgagttgcatatgatgggatmtcttgaatcatttacattttgaaaaaagaaagtgaaatattctttaagaagccaaagtaatccacgagaatgtatggtgtttgttcagctggatatctta

SEQ ID NO: 31324 - DNA, 201 bp, Homo sapiens
taggtttgagattgattttgaatactaaagtatagttttcatgttataaagccaaccatgttaaaaatgtataataaagtatctaatttagcaaaattcaratttcccctatgaaatatcaagctctttttatgcttcttcacatggcaccttgtgtagaatttgaaccactttaaacattgcatccttgagttgcatatg

SEQ ID NO: 31325 - DNA, 201 bp, Homo sapiens
tcatctgtgaaatgcagacctttctggacgtaccacctcgtggggtgaagggaaagaaatgatacaggtgtacatcagggtataagctgtcctagagtctrgattctttttatccagaagccattctttcagcctgtgcctttttgtaaataccataccccatctatttccacaaaggatttggggcattagcgagtaaag

SEQ ID NO: 31326 - DNA, 201 bp, Homo sapiens
aacctgcactaaaacttgttgctgcatctcacctaatcgtgtagtgagccaggtgagctcatctgtgaaatgcagacctttctggacgtaccacctcgtgkggtgaagggaaagaaatgatacaggtgtacatcagggtataagctgtcctagagtctggattctttttatccagaagccattctttcagcctgtgccttt

SEQ ID NO: 31327 - DNA, 201 bp, Homo sapiens
gtgtaaggtaatgttttcctagcaaaaacaaagagggctgaaacctggtgctcagaatcgtttggaaacggaactcctctccctcttctttttacaccaarataaagaaatactttgcaaatcagctgagcacatgttcccagctccgtgccgggctctgtggtcatgggtttccttctttatgtcttactcatctaatgt

SEQ ID NO: 31328 - DNA, 201 bp, Homo sapiens
tgtgagaagaagtgagaattgaaatgaaaggcatctagtcttccccggtccccatccacttgacccaccatacctcaagccacttctggctccatgctctktctttccttagggttttgaaacatgttcttcagcctagaatactcctcctccactcttaatttctacccatcctgcaaaactcagtctgaacagcacacg

SEQ ID NO: 31329 - DNA, 201 bp, Homo sapiens
agttacataattttgaaatcatttgacatttctgaggttaattttctacatcagtttagctgctttaggccgcaagttattaacacccacttaaaggtggytgaaataatagaggttttgcttcccatgtatccagagttgctgaggcagcaagggttgtgtttggctactatatgagtagctcctttgtgataatcttta

SEQ ID NO: 31330 - DNA, 201 bp, Homo sapiens
tagttacataattttgaaatcatttgacatttctgaggttaattttctacatcagtttagctgctttaggccgcaagttattaacacccacttaaaggtgkctgaaataatagaggttttgcttcccatgtatccagagttgctgaggcagcaagggttgtgtttggctactatatgagtagctcctttgtgataatcttt

SEQ ID NO: 31331 - DNA, 201 bp, Homo sapiens
tttacagtgcttgcttagtccagtgaccaatggatgtaagtaagttggaaaagggcaaaggatttagaatcatgagggttgtattcaaactgcagcctctrctcccttttagttacataattttgaaatcatttgacatttctgaggttaattttctacatcagtttagctgctttaggccgcaagttattaacacccact

SEQ ID NO: 31332 - DNA, 201 bp, Homo sapiens
ccattggttttagtagtcttacgtcattatgtccaaagcttttaagtttacagtgcttgcttagtccagtgaccaatggatgtaagtaagttggaaaaggrcaaaggatttagaatcatgagggttgtattcaaactgcagcctctactcccttttagttacataattttgaaatcatttgacatttctgaggttaatttt

SEQ ID NO: 31333 - DNA, 201 bp, Homo sapiens
ttaaaaaatggcttacgtttatggaacttctgcgacgatcgggttacgtttcctgtgcccgtgtaaagccagtcatcgtgctgagttttaacggatgtgcrgctaccctgctaatggatgggccggcaatgctggtcctgttgcaaagttataaattataactagaaaaagcacaagatgtcattcttctaaccttcgtga

SEQ ID NO: 31334 - DNA, 201 bp, Homo sapiens
ttaaggaatattgttgcagatcagtaattttacaattggatgttcttgtgcaactttattaaatgtgatctgtcttttaaatgttgcccttttacagttayacatttctaattgttgctgtaaatgcattatcactttgaaattaattaatttttccattttggctgcctgcaatataataatcactaatgagaaactcac

SEQ ID NO: 31335 - DNA, 201 bp, Homo sapiens
attaggttgatacagaagttattgaggtttttgccattgaaagtaatacgtcacttcatgcagaggtggaattggcgctctgagcttgcttgtcaaattcrcaggcattcacttttctttcataaacatttaggactctgtatttaggagaggaatcactgtgaatgtagacctcgggttggtcattttcctagtaagata

SEQ ID NO: 31336 - DNA, 201 bp, Homo sapiens
gaaatggaggcagagggactaccatgtcggggaggatgcacaatgaattggacgaaggttgcaactcagtgagcaccgtacctgtagtgtgtcttagtaayagcagatgcccaacctccatgcctaactcctttgcctaccccaccagtgtgcagcagcctctgccgcaccctactgcagtctctcctatttccctggcag

SEQ ID NO: 31337 - DNA, 201 bp, Homo sapiens
agctggtgtttaacgactccgtcagacccaattataaagcatcaactagttacgttgatttgtgtacatccatgccatgggtatacttaaaaacattagaytttgccagaactcatcttggctttgtttacatttttcttttaaacgtataagactattgatggtacctcaccaaggttataacccctttataatcattaa

SEQ ID NO: 31338 - DNA, 201 bp, Homo sapiens
ggagaaagcacccccatgattcacttatctccacctggctctgcccttgacacatgggggttattacaattcagtgtgagatttgggtggggacacagccraaccgtatcagtcaccctccaaaaatcacacaaaatctgaaagtgcttttattcattctacatgtaaatagttgttgcactacccacctggaaattcagt

SEQ ID NO: 31339 - DNA, 201 bp, Homo sapiens
tgagacttattcactaccatgagaacagtatgggagaaagcacccccatgattcacttatctccacctggctctgcccttgacacatgggggttattacarttcagtgtgagatttgggtggggacacagccgaaccgtatcagtcaccctccaaaaatcacacaaaatctgaaagtgcttttattcattctacatgtaaa

SEQ ID NO: 31340 - DNA, 201 bp, Homo sapiens
gacatcaggcaacagagtatgtgcaggggaattctcatttataaaaccatcagatttcgtgagacttattcactaccatgagaacagtatgggagaaagcrcccccatgattcacttatctccacctggctctgcccttgacacatgggggttattacaattcagtgtgagatttgggtggggacacagccgaaccgtatc

SEQ ID NO: 31341 - DNA, 201 bp, Homo sapiens
ggtaatttataaaggaaacaggtttaatgggctcacagttacacatggctggggaggcctcacaatcatggcggaagatgaaggaagggcaaagggatgtsttacatgacatcaggcaacagagtatgtgcaggggaattctcatttataaaaccatcagatttcgtgagacttattcactaccatgagaacagtatggga

SEQ ID NO: 31342 - DNA, 201 bp, Homo sapiens
atacccgagaccgggtaatttataaaggaaacaggtttaatgggctcacagttacacatggctggggaggcctcacaatcatggcggaagatgaaggaagrgcaaagggatgtcttacatgacatcaggcaacagagtatgtgcaggggaattctcatttataaaaccatcagatttcgtgagacttattcactaccatga

SEQ ID NO: 31343 - DNA, 201 bp, Homo sapiens
agcacctttgtgtgacacctcttctgtaataccttattatgttgaaataaagttagcaaataacataacttacatgcacaaatatattttcaattcgatakgatagctttactgtaatgaaagaaaaaataactgaaacaaaatggcgtgtgtttcaacatgtaaatgcttgggccaggctacaggaaagatggggatgta

SEQ ID NO: 31344 - DNA, 201 bp, Homo sapiens
tttctggaagcagttgacaaaagatgagtagagagagggagggggtggtgctatatttattccatacctttcagatactctctaaatccttgtccctgttktctatgccatgtaggtagagttttcaagtcatgtcccataccttggatcattggattctcaactcagtagcacctttgtgtgacacctcttctgtaatac

SEQ ID NO: 31345 - DNA, 201 bp, Homo sapiens
tcctgaagagtggatacttaatgtccatggaggcatgcatttttatctgccttgcatggcttctttcattctctccctgacttccacccaaaaaatcaccrtgatatccagctgtggaagagttcattatggagagcttcctggaagaagtagtccctgaactgggttgggctaaacaaatatgccaagaagggtttctgg

SEQ ID NO: 31346 - DNA, 201 bp, Homo sapiens
ttttcaccaatcttggaaggccagtaatgtcagtgaacactaggaatggtgtcatggcctgggtcctgaagagtggatacttaatgtccatggaggcatgyatttttatctgccttgcatggcttctttcattctctccctgacttccacccaaaaaatcaccatgatatccagctgtggaagagttcattatggagagct

SEQ ID NO: 31347 - DNA, 201 bp, Homo sapiens
gtctactttccaagaattcacagtctagttttggaatcaggtgatcaattgacttacagtctggtatggtgatgacagaggagcaatgtacagatagaacmgaaggatggcacagtgagccttttcaccaatcttggaaggccagtaatgtcagtgaacactaggaatggtgtcatggcctgggtcctgaagagtggatac

SEQ ID NO: 31348 - DNA, 201 bp, Homo sapiens
agaaaccaaaagccctaaacatgaggaaattccacatgtaaacattaatggaaaacatagaagagttgaacctagtggtaaattttacctttagagcaatrcttgaaacaagggaaactgtcaaattctcatcatgggatttgtgttcctttgttttttttattaaggacttggtccttggattggaattccaaacccatg

SEQ ID NO: 31349 - DNA, 201 bp, Homo sapiens
gattagggatcaagaagaaatgactttctcctcttagacatttaattcacttagtgttccctagtcatgacatacttctgtgttatccttaaatactgaarcagggaccttattcttaacagtagaaaatcactgtgtatgatgatagtgtatacctgtaataccagctactcaggaagctgaggcaggaggatcccttga

SEQ ID NO: 31350 - DNA, 201 bp, Homo sapiens
aattctattaagacataattgtttggctttgtcagtttgtcaacttgaaaatagagtcagcagcatctaaagagttgttttactacctctggagctgagasgtgaacatagtcgtttttcaggaagccgtttctggctcagacagataagaagctggcccacccttgccacttcctggaggactgtcagtgctagctaatg

SEQ ID NO: 31351 - DNA, 201 bp, Homo sapiens
agacatgtgggtggactcagcttggctcacttaatttttccaggtcttttttgttcgcctgtgattgtgggggactgtttagaaggactttctagagcaasgaagattgtttttacgactatacttcaagctcctcattgattttgcttagagatggaataataattgatgaaatctgaatggcatgacctttattgattt

SEQ ID NO: 31352 - DNA, 201 bp, Homo sapiens
tttattacttctaagttccattgcaaaaatatgctgcctgctctgtcagccaccctatatgcctatttagtcccagttttccagcttctatttttttccamataatccctaaccatgataatacaaatataatagaaataattatgtttgtttaaaatatacacagaaccaaatagtcatagagtagtatttcaggtgggg

SEQ ID NO: 31353 - DNA, 201 bp, Homo sapiens
tgccttttgctatggggttgcatccacggaagagtttgaaagcccaaccatatggacatcatattattcatttttatttgccatccagagcttgccagcarccttttagatctctttccttggaaggttcagcaagatgcttgtaaatgtatgttgctttgttgcagacaatgtatatttaaaaagcaattatttgcccat

SEQ ID NO: 31354 - DNA, 201 bp, Homo sapiens
caattgtggaagcaatgaattgaaggactagggtcaccagtggagtcccataaataggttgtttatgatccctgtgaaacaagaagaccctcttaatttcmtgcttcttaaactggggtatgagtggccccaggtttccctgttgggggtactgataccagagttcatttgaagtcattggaaaccaaggcatattttctt

SEQ ID NO: 31355 - DNA, 201 bp, Homo sapiens
aaatgaatggcatatgcgtatgtttcaagagctccagcagcctacccaggatggcttgatgttgtctcttagcaccgtatcaatacctgggggttttcaartattgcaggtggccgaagcctttgtgttgaggtttctgtagtgtttatccatttgtgaaaccaggcctcaatctatatgtccaacgccattcgtagaccc

SEQ ID NO: 31356 - DNA, 201 bp, Homo sapiens
ctctctattgcatattaacccaccatattgagagaatagaaacttttgccttcattatatcacctttacaccccaggacaggtgccctcctcagcggagasaactgtccccctccatcctgcaggagttttgcagccatccttccagccactgcttctctaccggggcaaattttcccccaagggataattgataatgtct

SEQ ID NO: 31357 - DNA, 201 bp, Homo sapiens
ccaggtctgactattaaccagattttggaacctttagggcttattatttagtaatccctgaagctctcaagtaggcgtttttaaattcatgcattagaacrgattaaaaattagctagaaacgcatgttaaatggcccactccctttcttttgctaattgtgctagaaatgaaaaagaaaatgcaagtgaggtcagatcta

SEQ ID NO: 31358 - DNA, 201 bp, Homo sapiens
cccctcctgcacaactgtggcgttctctttttctgactagctgattctgctgctgctggatttattcattcttctccctcacaattttggctcgcacatgmttcctttttagctcatgaccgtgcaattcaactcaacctcatggcatctttttatcagctgtccctgctgcaacaggcttagagttggtttcccaattcc

SEQ ID NO: 31359 - DNA, 201 bp, Homo sapiens
aagagataatgttggcaagctgaggaaaggaggcagttttgggtaactgtctcttgcgatcccctcctgcacaactgtggcgttctctttttctgactagstgattctgctgctgctggatttattcattcttctccctcacaattttggctcgcacatgcttcctttttagctcatgaccgtgcaattcaactcaacctc

SEQ ID NO: 31360 - DNA, 201 bp, Homo sapiens
ctatctctacaaaaattagctgggcatggtgtcacgtgcctgtagtcctagctactcgggaggctgaggtgggaggatcgcttgagccccgggaggtagasgcatgatcatgccacttcactgcggcctgagctacagggactctgtctcaaaggaaagaaaacaaacaaacaaaaagccatgtagagctgggctatccaa

SEQ ID NO: 31361 - DNA, 201 bp, Homo sapiens
aattagccaggtgtggtggcatgcatctgcagtcctggctactcagaaggctgaggtgggaggattgcgtgagcccaggagttcaagaccagcctgaacgmcgtaaaaagacctatctctacaaaaattagctgggcatggtgtcacgtgcctgtagtcctagctactcgggaggctgaggtgggaggatcgcttgagccc

SEQ ID NO: 31362 - DNA, 201 bp, Homo sapiens
ggagacgactgaggctcacagaggttaagccacctacccaggctggcaccgcacactttgttcagagtgggcctggcatacggcatcagttcagcctggcmctagacccttttcctcccacaaccatattgcccccagtggagagacaggaaagcagggaagggggcaattgccaagcctgtttctagaatctcaaggatg

SEQ ID NO: 31363 - DNA, 201 bp, Homo sapiens
tgtttacagtgtgggacacctgactttcaccttttatgatacctgcctggggcatgcatgtggtgactttttccatctctggtctctatcttatctcttgygatgaactcaggtctataaagcatttgggcactgcctggcacataggatatgtccagaaaacactagctggtattaaaacagaggaaacatgggaactga

SEQ ID NO: 31364 - DNA, 201 bp, Homo sapiens
tcaatgttgagatcacatacatcctgaaaacactgtttaaataaaattttggcctgcatcctgtttttgaaaacttgcaatggcttgccaacgttttcaasttgagaagtttcacaaaaaaaattcggatttccagcttctttcaaaaacacaggtcaaacatcctgagcctgttctgtggtcagttactcattagcagcc

SEQ ID NO: 31365 - DNA, 201 bp, Homo sapiens
actctgccagaggttgaaaactcaatgttgagatcacatacatcctgaaaacactgtttaaataaaattttggcctgcatcctgtttttgaaaacttgcartggcttgccaacgttttcaagttgagaagtttcacaaaaaaaattcggatttccagcttctttcaaaaacacaggtcaaacatcctgagcctgttctgtg

SEQ ID NO: 31366 - DNA, 201 bp, Homo sapiens
ccatgttccaggcacggttgtaagcacttacaactagtgactcatttaaccatttcacaaatatttattttgagagcaagcacgggggtttatgtgatggytccacagagcagtgaaaagactcccgccctactgctcgcaacctcagatgtccctgggcactagcccatctgtatgtctttaaaaaaaataaattaaatt

SEQ ID NO: 31367 - DNA, 201 bp, Homo sapiens
tactacgcaaaagcaggaacatcatctgcttttgggtagttaagagttaagtatcactttgagctacaggatcatgattaaaaagcattctgttatcttayttcacaactctccacttttgtaaaagtttaggataccggcagggcagcaaatacctttaaatgattttatttaaatgtcagatttaattaaatccatgac

SEQ ID NO: 31368 - DNA, 201 bp, Homo sapiens
ggcataaaacgtgatttgactcccccttgcccatcacagttctggagttcacatatcatttgttactttgaaaaatgaacttttgttatttgattatggtrataaataatatacatggtagaaggagaagaaaatgaagaaaaatttagaaacttggacagaggaaaatgaaaatgttctattaattccactagcatgaga

SEQ ID NO: 31369 - DNA, 201 bp, Homo sapiens
ggctaccctgagctatgatcacaccacagcactccagcctggccaacatagtgagacactacctagatagcttaggagagttccaatgtttctgaaggatktttttttaaaagaagtattcatttaggtgacacatatttattgagacactaatatatgccaggaattattctattggttcctttggaggagacatgaata

SEQ ID NO: 31370 - DNA, 201 bp, Homo sapiens
gtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgactgaatacattaccacctccca

SEQ ID NO: 31371 - DNA, 201 bp, Homo sapiens
taagggttttttccatgtactggtttctctcctgcgtggtcttgttctacccttgaggagggtaccacttcctcattgcttagttgtcagtataaatgctyctttctcagagaggcccatcctgaccatctgtgtttttttcctatcaatgctttaacaaatgaccacccatgggtggcttacataccatgaatgtcttct

SEQ ID NO: 31372 - DNA, 201 bp, Homo sapiens
tgttaccagaatctatcaagctctttcctatctaagggttttttccatgtactggtttctctcctgcgtggtcttgttctacccttgaggagggtaccacytcctcattgcttagttgtcagtataaatgctcctttctcagagaggcccatcctgaccatctgtgtttttttcctatcaatgctttaacaaatgaccacc

SEQ ID NO: 31373 - DNA, 201 bp, Homo sapiens
gcccaaatctcagaagttggcgtttccttgcagatatcattggtggccattggaggggaaaaagatgctttggaaaccaggacacagagaaaagtgcctcrtattatacagagccaagagaggtcactgtggaagtacagaggaagccttggcctaattgcacggttaatacaattccgtaactcatcctgccaacacgaa

SEQ ID NO: 31374 - DNA, 201 bp, Homo sapiens
tcctctgcaagggatggggtcataagacattggtgaggttaggccttcctttgtctcccaggagcacacttgatagcaatgtagggtgaattccaaatctstgagttagtgccatatatagcagtgttgtcagtaagatttctcactggcatctctgcttcccctcttgactctcttgaaatcccttcttcaggcagaagt

SEQ ID NO: 31375 - DNA, 201 bp, Homo sapiens
caccactgctcgcattcccatgttggagttttccctttggggttcttatgccattttaaagactctgaaaacaggaagactttttctcttgggtatttttwtttttttttcctctgcaagggatggggtcataagacattggtgaggttaggccttcctttgtctcccaggagcacacttgatagcaatgtagggtgaatt

SEQ ID NO: 31376 - DNA, 201 bp, Homo sapiens
ttatcttacaagaggcatatttaggagatgtttccgttctattttatctgcagaattactttccattctcaggtcttttatataagtattcccttgaaccygttccaaaaactggatttttaacccaatagaccataactgcagtgttttattgtgcttacatatttcaaaatgtgaatgtaagtagatttagcaaagtta

SEQ ID NO: 31377 - DNA, 201 bp, Homo sapiens
tattccagcaattttttttttttagctctctttgtctggaactttgcaaaataaacaccatggtcactccgtgctttgtgagtgacgtgctagaatggaayttcactgttttaaattcagggttaatttcttgctttcaaatgaattatgaaaggaagaggagagacctttggaaaagtctgaatgttgatgccgacgact

SEQ ID NO: 31378 - DNA, 201 bp, Homo sapiens; identical to SEQ ID NO: 4914

SEQ ID NO: 31379 - DNA, 201 bp, Homo sapiens
ctctagagcaggggtccatgacctctaggccacaaaccaatagcggagccgtggcctgttataaattgggtggcatggcagggagtgagtggtgggcaagyataggaagctgcgtctgtgcttagagccgctctctgtcactctcattagtgcctcaggtcctccccctgtcagatcagcaacagcattagtctcatagga

SEQ ID NO: 31380 - DNA, 201 bp, Homo sapiens
ttgctctcagctgggtgcagtggcttatgcctgtaatcccagcagtttgggaggccaaggcggggagggtcatgaggtcaagagatcaagaccatcctggscaacattgtgaaaccccatctctactaaagatacaaaaaattagctgggtgtagtggtgcacacctctagtcctagctacttgggaggctgaggcaggaa

SEQ ID NO: 31381 - DNA, 201 bp, Homo sapiens
cccttccgacaatccttcatccttcccagacgtttcatcagccaagtgaaatttgcaattgtttcagtgattgaaattatgcttggagtgcaggtgtcatsgatgaaacagcaatgccttgcggtgacaaattcagtgtagaaataattttagcaagcccagtgattggaaaacaatgactcaactttaagctatattgat

SEQ ID NO: 31382 - DNA, 201 bp, Homo sapiens
gcccgtgaatttagttaaaggtttttaatgtcacttttattacatttttactgtgcattcatgtgcacacacacacttttaagcatttttgatttatatawccctctgcatattttgtgccttgtgatgtgtttaacgaatgacagtgtctttagtgcattgctacttggggtttctacactggaagtgtaatccgaggcc

SEQ ID NO: 31383 - DNA, 201 bp, Homo sapiens
tcggtagatttgtttatgattttaatggctgcatagtattctatcatatggatatattctaaatgtaataattcctcaatggtatatttagtttactttawatttgctgctttagtttgtcacaaacactgtggatagccttgtatatatttattttgttgtatagttcttattggtacagtatgatttttcacaagtata

SEQ ID NO: 31384 - DNA, 201 bp, Homo sapiens
catgcaaggtgctgtttatgaacaagggagtttcctgcagctttaataaagaagagaaaagaaaagaaagaaaggaaaattcgcatgttgaaaacattgtrctaatcaaaaaagccagtcacaaaggaccctatgttatatgatttcatttacatgaaataccccaaagaggcaaatctgcagaaacagaaagtagagtgg

SEQ ID NO: 31385 - DNA, 201 bp, Homo sapiens
gtgctgtattccgtaggaaaatgtagatgaatgtgggtcattgggaaataaagtgggtggaagtattggcgagcatttctttcccactctctacctcgccyggtctagccgctgataggtagttactctttagtatgcccaagttcaaattacgtatgactgtgattctaacacggaagcgccctccttttctagtagctt

SEQ ID NO: 31386 - DNA, 201 bp, Homo sapiens
gtgctgtcagggcccgtggcaaagggttccctcattccctctgcagttatttttcatgcacactcggattacactgctcggtgatattacatctgcatgcstcttgccctctgacacggcaaacacagatgctgcccgaatccttgtaaagccatatatcttaagtaggaaggagcatctttgcaggggaggtgaattgat

SEQ ID NO: 31387 - DNA, 201 bp, Homo sapiens
actgcagcctcaaacttctaggctgaagtgatcctcccacctcaacgtcctgagtagggagggcactacaggcgcatgcctccacatctgactaattactraatttttaaaaatttttttagacactgagtctcaccgtcttgccctggctggtctcaaactcctgggctcatacaattcccctgcctcagaatcccaaag

SEQ ID NO: 31388 - DNA, 201 bp, Homo sapiens
ggtctttgctcttccactgccaagaagtaaggttttggttgggcgcggtggctcacgcctgtaatcccagcactttgggaggccgaggtgggtggatcackaggtcaggagatcgagaccatcctggttaacaccgtaaaaccccgtctctactaaaaatacaaaaaaaaaaaaaattagcccggcgtggtggcgggtgcc

SEQ ID NO: 31389 - DNA, 201 bp, Homo sapiens
taatccgcccacctcggcctcacaaagtgctgggattacagacatgagccaccacacccgccctacatgggtattctaacccagtctagtgatagtccaayctcctgtactatgagtaattagcaaagaattaacagcagaagatcgctctcaccaaagcccatccagaaagtggctcgtattcaaggtgctaattagggt

SEQ ID NO: 31390 - DNA, 201 bp, Homo sapiens
cgtggcctgttataaattgggtggcatggcagggagtgagtggtgggcaagcataggaagctgcgtctgtgcttagagccgctctctgtcactctcattastgcctcaggtcctccccctgtcagatcagcaacagcattagtctcataggaccgtgatccctattgtgagccacacatgcaagggatctaggctgcatgc

SEQ ID NO: 31391 - DNA, 201 bp, Homo sapiens
gtgatggcttcttctgttctctttatttccttaactgaacatctgtctaattgttcacctccatcgctttagtgctttcctcatgctttctctctttccasacaataaactttattttcttcataagaattcagtctacgcaagggtattaggcagcttgtttgcaccttttaattgctggatgttttccagaaaggctgt

SEQ ID NO: 31392 - DNA, 201 bp, Homo sapiens
ggctgcatagtattccatggtgtatatgtgccagccatcccgttactgggtgtatacccaaaggactataaatctttctgctataaagacacatgcacacrtatgtttattgcggcattattcacaatagcaaagacttggaaccaacccaaatgtccaacagtggtagactggattaagaaaatgtggcctttgcctctt

SEQ ID NO: 31393 - DNA, 201 bp, Homo sapiens
aatcataatgtctcaaattacttactcaataaaatgtgggtttgtctattattagtgattattagggttataatgcagcatggaaatttggagcaaattawctatacatgcaagctgttgggctcaagtgcagttaatcatacgcatacagtgccagtgggcagaaggttttgcaagaatagcttcaggaagactttgtgg

SEQ ID NO: 31394 - DNA, 201 bp, Homo sapiens
ctcaaaaaaaaaaaaaaagccagattctccacctaccagtggtggggccccttgggtaacttgttttcactccctcagaacctcagtttcctttcctatayaacgcaagccataaggttaacccctcctcgtggtgatgttaagatgaaacaggaaggtgaggggcttaacacatttccgtgttcccataagctttcagga

SEQ ID NO: 31395 - DNA, 201 bp, Homo sapiens
tcactagtaaaatttggccagacacggtggctcatgcctataatcctagcacgttgggaggctgaggtgggtggagcacctgaggtgaggagttcgagacyagcctggtcaacatggtgaaaccccatctgtactgtaaatacaaaaaattagctgggcatggtggcaggcacttgtaatcccagctacttgggaggctga

SEQ ID NO: 31396 - DNA, 201 bp, Homo sapiens
agcacaacacatcccatccttctggataatctcttctaccctccctttccagataaaagttgactctcataattgtaactctcccctactttatcagcatstacatctttcagcctctaccacattgaattggaattatatgtctgttttatgtaccatgctgtgaactccttgaagataggagctgtcttatcttcaagg

SEQ ID NO: 31397 - DNA, 201 bp, Homo sapiens
ctgtgtgacaattctggatttccttagctgtcctctgcctccatctccctttctctgtaagtggaagtggtattcattgatcacacactacatgccggacwccaagctattacattttttgaatatgtttcttctttgcctcttgaggactaaccagccgggtttagattatttcctccccgtgtcgctttcctgccccca

SEQ ID NO: 31398 - DNA, 201 bp, Homo sapiens
gagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaa

SEQ ID NO: 31399 - DNA, 201 bp, Homo sapiens
gacattgtttgataaaacagacccagtcactggtgtcagggagtttatataaaagtatacacgtatctgtgcaaatgtgtgcatttaaggcccgccgagcmtgagctgatatgcatgtcttaactttgctgtttctctaaggggatggaaggattggctaccctgagctttctagacttgttattttttttttttttaaga

SEQ ID NO: 31400 - DNA, 201 bp, Homo sapiens
ttttcttttttgagacagggtctcgctgtgttgcccatgctggagtgcagtggtgcgatcacagctttctgcagcattgaccttgtgggctcaagcaatcstcctgcctcagcctcccaagtagcttagaaccacaggcatataccaccatacctggacatgtttttaactttaatttttatttttgtagagatgaggtct

SEQ ID NO: 31401 - DNA, 201 bp, Homo sapiens
acacatcttgtctattatgccagctgcaactcaaatcaaaggcactgttgctttggtacccgcatttaaggagggaataccccaaaaaacttaaacttgtstggctttgcaatggtggtggagtcccaagatgacacagtaggcaagatttgattactttggttatgcaaatttcccctagatcttctattaatgacagta

SEQ ID NO: 31402 - DNA, 201 bp, Homo sapiens; identical to SEQ ID NO: 8635

SEQ ID NO: 31403 - DNA, 201 bp, Homo sapiens
tgaaataatgactagttaattactataaattctaagtgctccatctctgacaattaaaaattgtcttacagctttttatttatttatttattttttttagwtctttccaaattatattaagtgcagcatctggggaaagaagaatgggaatggaaggagtgtgtttaaaatgtgggtggttttgtcaattcctattgggaa

SEQ ID NO: 31404 - DNA, 201 bp, Homo sapiens
tggatgttgatttctaaaggaggtaaaacttgaaggtagacaagctctttgtgtccatacatttgatgggtcatcctatgaaggagggcccatctcttacrgcaggcagcgtggcgtaggcctcagagtcaggcatctggggcccagccttttctctgcaggtgcgggtggctcttggcacatgatgtaggtttttgtttt

SEQ ID NO: 31405 - DNA, 201 bp, Homo sapiens
cgcgttccccttgtctgtgcaattcccaacagaggcaagtgcgcatttgagacaggttgagggttcaagctgtccaatccctgctcatctgcagcacaccraggaatgtggactaatgaaaaataaactgcatgcatgcagtgcccatcacactgcctgcattttctaatcttcacaataactctgtgttgagaaatattc

SEQ ID NO: 31406 - DNA, 201 bp, Homo sapiens
tgcgaaggataagataattacacaagaggcaccagaaccactgaatgtggagagctctcataaatgacaagctgcctttgggttaggctctgttgggaacrttagttctgcagtgttgcaagcagatgaaggatgtgagggaagggatcttaaaccagatattcaaatggccctgtggggagctgacaccacactgctgtc

SEQ ID NO: 31407 - DNA, 201 bp, Homo sapiens
ttcttccaacttctctgcttttggtctctgtggatttgcctattctgggtataccacataaaaggaatcaaagaatatgtgaccttttgtgtctagctccrttcacttagcatgctgtttccaaggcttgtctaagttgtggcatgtgtcagtactttattcttttttatggctgcatagtattccactgcatggatatac

SEQ ID NO: 31408 - DNA, 201 bp, Homo sapiens
ttggatttagagcccaccctaattcactgtaatcacatcttacctaagtccatctgcaaagaccctatttccaaataaggtcacattctgaggccctgggkggacatgcattttagggaccctttcaggccaccatatatggattccagagtgaccagtagaacatagctcaggccaagagagaaactcaaccttggtgaa

SEQ ID NO: 31409 - DNA, 201 bp, Homo sapiens
actttgggagtccaaggcaagaggatcacttgagcccaggatttcgagaccaacctggacaacgtacagagacctcatctctacaaaaaataaaacagctrggcatagaggcacacctgtggtcccaggtagttgggaggctgaggcgggaggatcctctgcacccaggtagccgaggctccagtgagtcatgatcatgcc

SEQ ID NO: 31410 - DNA, 201 bp, Homo sapiens; identical to SEQ ID NO: 8636

SEQ ID NO: 31411 - DNA, 201 bp, Homo sapiens
gcactttgggaggccgaggtgggtggatcacgaggtcaggagatcgagaccatcctggttaacaccgtaaaaccccgtctctactaaaaatacaaaaaaawaaaaaattagcccggcgtggtggcgggtgcctgtagtcccagctactccggaggctgagacaggagaatgtcatgaacccgggaggcggagcttgcagtg

SEQ ID NO: 31412 - DNA, 201 bp, Homo sapiens
cccaggagtctgtgtttgttctttaaacctctctattcagttgcccagctcttttcattccctgtcctttccccctctggctgggtctgcctttccaaccrctaccaccttccaccaccattttttttttgtttcctctgcaagcaacatctgaaaggcccagacccagcttgttggccttgggctctgataagatctgtc

SEQ ID NO: 31413 - DNA, 201 bp, Homo sapiens
ctctcatttcccaggatggagtgcagtggtgcaatctcctccgcctcccagtttaagccattctcctgcctcagcctcctgagtagctgggattacaggckcccgccaccatgcccggctaattttttgtattttttagtacagacggggtttcagcatgttggccaggctggtctcaaactcctgacctcacgtgatcca

SEQ ID NO: 31414 - DNA, 201 bp, Homo sapiens
ttttctagtcttagatattatctgtaggtttttcaataagaaggaaatttagcttccttctactttggtgccccatgatgatgtgcatcttttttatttcygcatcatatccatatagtgatatcatgtataatgatgtttaagaagacagttttttttgtttaaattgttataaataagtaagtgtatgcaccactatgc

SEQ ID NO: 31415 - DNA, 201 bp, Homo sapiens
aaatactgggattacaggcatgagccatgtccagctgccttgtttttttctttgaagagaatgatagaccttccataggaaaaatgttaaatatgtgtgtrcagaaataaagatttcaaatatttttgcaagatattttttctaataccacttttttctacattttccataatttagtgaagatagtaaattaacaaagtg

SEQ ID NO: 31416 - DNA, 201 bp, Homo sapiens
atgaaggacgctattttaatggggtgatttttttcttctcactacattcttgctcactccccactttttatgtccggtggccataggctggtgagaacttkattttgaacagttgaaggtctgctgttagggacgtgctaatctagggaattgtactgaactcgtgggagcatgttagtatcagatgtgtgccttgtccgt

SEQ ID NO: 31417 - DNA, 201 bp, Homo sapiens
attaagggaaaatcaagtaaatcgagaggtaaagcactgtgcagaaatattggccagaagctatgaacagttgccacagctgggctgaagagttacctgtsagccttccaggggtgtaagccaagagaaagacagttcaccaaatctatcgattaatagaaatcatccagcagcagtgccactgtaagatgttcaatacgt

SEQ ID NO: 31418 - DNA, 201 bp, Homo sapiens
gagtttcactctttcaatcaacgtacgtgactacccagaattaaactggaatgctgttaataagagaaatgaaaggatgatgggagatgtgcacccagcartgtctgtcttgtggtcctgaagtctaactctaatcctggctccactatctggaccatgacaggttgtttaattgttctagttagagtgttctcctatgta

SEQ ID NO: 31419 - DNA, 201 bp, Homo sapiens; identical to SEQ ID NO: 4912

SEQ ID NO: 31420 - DNA, 201 bp, Homo sapiens
ctgcagaggtgctgcagtattaactgaggcaacgttgcaccgtttctagaatgatatttagggctcatattgacccagtaggaagtatagttaccttgggmcaggggagctacctgagtggagtcaacttttaggttatagggaccaagttgaaacatgcttaaaattcacaagtctgtaccattctgtccttcaggtacc

SEQ ID NO: 31421 - DNA, 201 bp, Homo sapiens
tcctggttttcagcctgaggaggaaggtggctttatttaactccttcagccccggaacatcacagggcccttctttgtgcattctgggttctaacagcccyttgaacagtgcttgagagtatttccattataaatgtcgaatcggcattgaaggaacatctgttttaagtcaacttagactcaatccaggaaaaaaaataa

SEQ ID NO: 31422 - DNA, 201 bp, Homo sapiens
tgatctcattgttcagttgtcacctatgagtgagaatatgcgttgtttggtgttttgttcttgcgatagtttactgacagtgatgatttccaatttcatcsatgtccctacaaaggacatgaactcatccttttttatggctgcatagtattccatggtgtatatgtgccagccatcccgttactgggtgtatacccaaag

SEQ ID NO: 31423 - DNA, 201 bp, Homo sapiens
gtgtgtgtgtgtgtgtgtgtgtgtgtgtatacctagtctagggctaggtttgggaactattttctcccgtaagttaaactgaactagactgtatgtcaaaraagagtctcaatgtcaacttaatccattgtcatgactgtaaaatgctatttcattataccagcaattcccctgtggatttctcctgactctctatgcagc

SEQ ID NO: 31424 - DNA, 201 bp, Homo sapiens
ggcttttattggccagtatattcaatgattcacttgcacctttaaccttgtgttgttctaatctttttttttttttttttttttttttttttttttttgaracagagtcttgctctgttgtctaggctggagtgcagtggcaccatctcggctcaccacgagctctgcgtcgtgggttcatgccattctcctgcctcagcc

SEQ ID NO: 31425 - DNA, 201 bp, Homo sapiens
tccatatttatttttctccaccttgggtgaaaaaacttcgcttttcgtaatgtggtacagtgtgtgcttctgtaaatggaaatggtttcagcacatcacartcatgcttccctgttgaaagatgctccgttttcccgcatacatgatgtccagcacaacgtctgatttatgagagcatgaccctgggggcctctggaacag

SEQ ID NO: 31426 - DNA, 201 bp, Homo sapiens
ggatgattagtatattcttatttggcctgggagggaaaaaaaatctttcatttccaacaatattcattctctgtgtcacctcagcatttaatttacttccrtcacaaaactacttgaagttgtcccaggctagttggtcctattaattacaacctagagggattctattagtaaactaatggattacagtacctaaatgga

SEQ ID NO: 31427 - DNA, 201 bp, Homo sapiens
atatattttcaattcgatatgatagctttactgtaatgaaagaaaaaataactgaaacaaaatggcgtgtgtttcaacatgtaaatgcttgggccaggctrcaggaaagatggggatgtatgtatccgtggatgaatcaccttgaatggactctcataaaaaagcccaccattaccaggtgtgtggtattgcagactccag

SEQ ID NO: 31428 - DNA, 201 bp, Homo sapiens
ggccatacttagtggctcacgcctgtaatcccagcactttgggaggccgaggtgggcgcattgcctgaggtcgagagttcgagaccaccctggctaacatkgtgaaaccccatctgtaataaaaatgcaaaagatagttgagcgtggtggcgcatgcctgtagtcccagctactttggaggctgaggcaggagaatcactt

SEQ ID NO: 31429 - DNA, 201 bp, Homo sapiens
gtttccaatgataacagccatctgacttgatcggagttctatggattttcactaaaatagaatcatcgccttggtgatggatagaaaaagtaaagcaatayatcctgataaatgctgtgccttcctccttcgtctctctggcggtgaccttgtgcaatccataagagggcaaggctgagagccccggccaccgccgccgtg

SEQ ID NO: 31430 - DNA, 201 bp, Homo sapiens
ggagggaccgggtgggagaatattgaatcatgggggtggttcccccatactgttcttggggtagtgaatgaatctcatgagatctgatggttttataaggsggaaacacctttcacttggctctcattttctcttgcctactgccatgtatgatgtgcctttcgctttgcactatgattgtgaggtctccccagccacgtg

SEQ ID NO: 31431 - DNA, 201 bp, Homo sapiens
aaataatattaccggagaaacaatgagtaacatgtataggattttttttttttttttttgacggagtcttgctctgttgcccaggctccagtgcagtggcrtgatgttggctcactgcaactccgcatcctggtttcaagtggttcttctgcctcagccttccaattagcggggactaccagcgcatgtcaccatgcctgg

SEQ ID NO: 31432 - DNA, 201 bp, Homo sapiens
acccttccgacaatccttcatccttcccagacgtttcatcagccaagtgaaatttgcaattgtttcagtgattgaaattatgcttggagtgcaggtgtcayggatgaaacagcaatgccttgcggtgacaaattcagtgtagaaataattttagcaagcccagtgattggaaaacaatgactcaactttaagctatattga

SEQ ID NO: 31433 - DNA, 201 bp, Homo sapiens
aattcaactcagaggtcagcttcactgcctgccctgtggagtcgactctgtgtcccacccttcaggaatacggcttaataataagatgataaggattcgtrccagggattggcaaatgacagtcattttctgtttccttaagtaaaattttattaaaatacagctccactcattcatttatatattgttcatatctaatta

SEQ ID NO: 31434 - DNA, 201 bp, Homo sapiens
agctcctccctcctgctagcatttttctttgagtagttttattaatgagaaaagctgttgagcaccagagcaaccccgcctcttctaaataccatctgacrtatacattcagcagaggaaaaatgatgtgaggtctggggcttgctttaaaatactttggggccagacacagtggctcacacctgtaagcccagtgctttg

SEQ ID NO: 31435 - DNA, 201 bp, Homo sapiens
caatcctcctgcctcagcctcccaagtagcttagaaccacaggcatataccaccatacctggacatgtttttaactttaatttttatttttgtagagatgwggtctccctatgttgcccaggttgctctcaaactcctaggctcaagcagtcttcccaccctggcctcccaaagtgcaggcattttaggcatgacccatcg

SEQ ID NO: 31436 - DNA, 201 bp, Homo sapiens
ggagtgcagtggcgtaatctcggctcactgcaagttctgcctcctgggttcgtgccattctcctgccttagcctcccgagtagctgggactacaggtgccygccaccacacctggctaattttttttttttttttttttttgcatttttagtcgagacagggtttcaccgtgttagccaggatggtctcggtctgctgatc

SEQ ID NO: 31437 - DNA, 201 bp, Homo sapiens
aatagaatgactaacattttctgagggtgtctcacgtgaaagtaaatcgctcatgtttgttctttttaaaagatgcccttcgtattgtgtatcttgcagtsttgctttctcaaacttaagccaactatatcgtcatttttgcaaaatcactgcgtcagtttactattatttaatgtttattgctaccaattttaagaaatc

SEQ ID NO: 31438 - DNA, 201 bp, Homo sapiens
taaatctgtgtttgccagtttgcctccaccactgatgtgctgttggggtttggggacataatttcatcactttctaccacctttccttaaaactaggcttygtgccaggtgcggtggctcacgcctgtaatcctagcactttcggaggccggggtgggtggatcccaaggtcaagagattgagaccatcctggccaacatg

SEQ ID NO: 31439 - DNA, 201 bp, Homo sapiens
aagctatgaacagttgccacagctgggctgaagagttacctgtgagccttccaggggtgtaagccaagagaaagacagttcaccaaatctatcgattaatrgaaatcatccagcagcagtgccactgtaagatgttcaatacgtagcacctttctgtcccttctcctctagccagttgggacaggattagcaagccaaaga

SEQ ID NO: 31440 - DNA, 201 bp, Homo sapiens
gttggatatagccttatgttcccagcaggaaggaagaaaggaaaggagggagggaggtaagggtgagagagagacaagaaaggaaaggaggaaggaaggaygggaaggagggaagaagagagtttggtcaacatttgttgattgtgaatgaacaaactaatgaacactaaatgaacaaatgaatgaatgaatggacaaatg

SEQ ID NO: 31441 - DNA, 201 bp, Homo sapiens
catagggtatttccagataatgtagttaacacctcgtgtaatattaggtgggcagggagctctgctctcaggaccaaaattgctcctgccagctctaatarggaatgtgtgtatttttaaagtctgggtaagcactgtgagtcatttccacaatacgcctccctttggcgtgaaatggggcagaaagtgccccaaacagct

SEQ ID NO: 31442 - DNA, 201 bp, Homo sapiens
ccaccaagcaaggcagactatttcgtgagaaagaaggaagatagactccatgcaacacagtgggtgtggcaccaagcgggaggtggagggttgctacctastcccggctccacctactgtcacctgcattcccctagacaaatcacagcacctcaggatccttgatctcatcatctgtaaaacagagatcagatgaaccct

SEQ ID NO: 31443 - DNA, 201 bp, Homo sapiens; identical to SEQ ID NO: 4877

SEQ ID NO: 31444 - DNA, 201 bp, Homo sapiens
atatttgaatgaatgtgccaggacacccaattagaagaatgaatgcttttttagcattattttgtgtgcatacatatttatttagttatttgacctattayattctaaattgatattaataaagaggtatttgagttacagtttttccaaagttttaaatactctatagcaaaaaaaggaaaaatgaaagaaattaaaaag

SEQ ID NO: 31445 - DNA, 201 bp, Homo sapiens
tacgtgggtttcaaaggtactcttttttcttttttgagacagggtctcgctgtgttgcccatgctggagtgcagtggtgcgatcacagctttctgcagcaytgaccttgtgggctcaagcaatcctcctgcctcagcctcccaagtagcttagaaccacaggcatataccaccatacctggacatgtttttaactttaatt

SEQ ID NO: 31446 - DNA, 201 bp, Homo sapiens
ttagtgctttatctccttgtgtgtgtgagtgtgtgaggggatcaattatatacataagacaaagaccacctaggaaatgtttgagaaactgtgcagtgagratgaatcaacaagtaaatatcatgagaatttcttagattgaagaaatattactcctatttggtgtcaactctgtgctggccttttcactcaagttctctg

SEQ ID NO: 31447 - DNA, 201 bp, Homo sapiens
tgcctcatcagttagtggtgtgatgtgtttgcctgacaaataccatctaggaccctggctgcatgagcttgttgagacagctaaattttacaggtagttgrggtttcaccatttaacccagttaactcttctataagtgccgtattaaagcaggtggtgtattttgaaagacgtatgtaaaaacatttgtatttatttata

SEQ ID NO: 31448 - DNA, 201 bp, Homo sapiens
tggcatctagtgggcaaaggccagggatagtgctaaggatcctgcagtgcaaaggagcatgcccaccacaaaatatcagcagtgccgaggttgggaagctytgtgccattgtgcaaagattcaaggtggctatgtcacaggactggtacatgtccttttttttttttttttttttttgagacggagtcttgctctgtcgcc

SEQ ID NO: 31449 - DNA, 201 bp, Homo sapiens
gatttgaaatatgtgccctgaagttttgctatgttgaaaaaaatgatgagccgggcacagtggctcacgcctgtaatcccagcactttggaaggccaaggmgggtggatcacctgaggtcaggagtttgagaccagcctgaccaacatgttgaaaccgtttctctactgaaaatacaaaaattagccaggaatggtggtac

SEQ ID NO: 31450 - DNA, 201 bp, Homo sapiens
atgatcttgccactatacatcagtctgggtgacagagcgagactctgtctcaaaaaaccaaaacaaaggtcaattttttttccacattcatctataaaacrataaaggaaacatcctagacacttgaatcagagcccttttaattatgacttcaaaaaacagggctcgtgccacccaagatttcctccatatacaaaaaaa

SEQ ID NO: 31451 - DNA, 201 bp, Homo sapiens
tacaggcgcccgccaccatgcccggctaattttttgtattttttagtacagacggggtttcagcatgttggccaggctggtctcaaactcctgacctcacrtgatccacccgccttggcctcctaaagggttgggattacaggtgtcagctagtgcacctgaccctaggataatcttaattttaagtaactggtaactcat

SEQ ID NO: 31452 - DNA, 201 bp, Homo sapiens
aggatgggtgctttgtggcccttttcttttaccggctgactagaatgttgacgttaaagcagttagagtccgagcaggcaactccgaccccaagttggagmtgtgtgttgaagatagaagagcaaatatgtagaaggaacctggatttctatttttttaaaaaatataataaatcatccagccccaaatgtcaggaacctg

SEQ ID NO: 31453 - DNA, 201 bp, Homo sapiens
tagtcattttcagagacaaaaatttgggaaaaggattgtagaatgactggcttcccaaaaccacttggtgtttacaaagttatcaaaaacgggctgggacyactgatggtaataacaaaacctggggccctgaatcgtgtattctacatccgttagcacactgaagccacaccgcaaacttgtgaggccagcgttgcttcc

SEQ ID NO: 31454 - DNA, 201 bp, Homo sapiens
gcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccc

SEQ ID NO: 31455 - DNA, 201 bp, Homo sapiens
gtggctgaaatgagactctttcacactgtttaaagatgcatgtgcatatgttggtgtccacacatcaacttaattttttcatgttccttgaaggaagcccktctaggtccttctgaaagaagggctggagatttttattaaacattacttctaggctgggtgcagtgactcatccctgcaatcccagtactttgggaggcc

SEQ ID NO: 31456 - DNA, 201 bp, Homo sapiens; identical to SEQ ID NO: 8637

SEQ ID NO: 31457 - DNA, 201 bp, Homo sapiens
cttttgctcccttttctccccactcttgactcttctctagtttttatatgcagtttgtatttatccatgccatctgaaatcctccttcctttttaacaagrcaagtagaaaacgaaaacaacatcaaaggatacactacacaattgttggagccctaggaaccgagagaagagtacaagcaggttcttgaactgttctctc

SEQ ID NO: 31458 - DNA, 201 bp, Homo sapiens
cacctggctaatttttgtatttttagtagagacggggtttcaccatgttggccaggatggtctcgatctcttgaccttgtgatccgcctgccttggcttcycacagtgctgtgattacaggcgtgagccaccacgcccggcctctttgcacattatttaagggtgttttaacaaaatggcaatttccccaggctggcttgt

SEQ ID NO: 31459 - DNA, 201 bp, Homo sapiens
tgacaccacactgctgtctagtgtccaattctccttgcatggctgtgtcacccaggttggaacgtagtgcacaatctcgccttaatgcaacgtcccactgygggcccaagtgattttcctgtcccagcctcctgagtagctgggactacagatgcctgccaccatggcctgctaatttttgtatttttagtagacataggg

SEQ ID NO: 31460 - DNA, 201 bp, Homo sapiens
ggctgaaacacagcacaacccacccccccgccccaccccccagcctgtaggtttagcagaatcccagcctcacatcctccccgaacttggcagtaaaagcsctgttcttccattcattccgatgatttatattctctctgggcgtcttatattaaacaggggaattccgacatgttccataacacatttactgtaacttga

SEQ ID NO: 31461 - DNA, 201 bp, Homo sapiens
tatacacacacatatatatatatacatatacacacacacacacacacacacacacacacacacatatattttttttttcttttagatggagtgtctctctrttgcccaggctggggtgcagtgacatgatctctgctcactacaacctctgcctcctgggttcaagtgattctcctgccttagcctcccaagtagctggga

SEQ ID NO: 31462 - DNA, 201 bp, Homo sapiens
gatttctttcccccttatttctgaaagctcacctctttacagctggcaaggccagcagaactgaacaatagagccggattaagcaagcattcaggtgcccwcttaattcaatcggcgaatttgcatttctcaggctctgtgccatgagagcctgccgcctcaagggaccacctgccttctaccagaaggactttgctcctt

SEQ ID NO: 31463 - DNA, 201 bp, Homo sapiens
ttttgtatttttagtagagacagggtttcactgtcttagccaggatggtctcgatctcctgacctcgtgatctgcccgccttggcctcccaaagtgctggsattacaggcatgagccatcgcgcccggccagagggctattctttgtcttttatttgctttgagtctggtataaccatgtggcacatacccctgtacatgt

SEQ ID NO: 31464 - DNA, 201 bp, Homo sapiens
gtagttctctgtaaaactagttggtgtaaggaaacttggtctttgaccatcaaggaggttgcagtttgtggcatggcacaaagataacactcagcagatayatagctatgggatacatggatggatggatggatgggtggatggatggatggatggatggataggtagatggatggatgcgtgggtgtgtggaatggtggg

SEQ ID NO: 31465 - DNA, 201 bp, Homo sapiens; identical to SEQ ID NO: 8638

SEQ ID NO: 31466 - DNA, 201 bp, Homo sapiens
catgccagagtgaaaacgcgaaagaaaataaacaggcagcactgaggaattatacacttgagcttggcatttttcttaacgcagggctattttaggtgcastgcgcatgttggaggtgcccttgcaggtataggtaggcattgtccatccgtggtaaaaagcaatagaagaaattcttacccgatgcttaatgaattgcca

SEQ ID NO: 31467 - DNA, 201 bp, Homo sapiens
cgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaa

SEQ ID NO: 31468 - DNA, 201 bp, Homo sapiens
ggttgcagtgagccgaggttgtgccactgcactccagcctggctgacagagggagactctatctcaaaaaaaaataataaaaataataaaaaaaaaattayatgaaaaatagagacaaagtctcgctttgttgcctaggctggtcttgaactcctgggttcacgtgatcctcctgcctcggcttcccaaagtgctgggatt

SEQ ID NO: 31469 - DNA, 201 bp, Homo sapiens
ggttgtttgggagggaatgataatgacaagaacagcagcggagtcagcagctcatttactgagggcttatgggccatacgtggaaaatattttgcatgtaygttttgattcaattctcaaagcagtccttgggagtagatgctattaatatctctactatacagataaggaaagtgaggctagagaggatatataatttat

SEQ ID NO: 31470 - DNA, 201 bp, Homo sapiens
tcaattctggtcttcaccatctgccaatgtgagttttagtttctctataaacttttaaactttaaactttttttcttttttttttgggggggggggcaatscattcttaacccccttccagtttttctcagcctattcttgtttgtttttgttttctatttctgtttcattgagatgcatacaaaatggaagatggccaac

SEQ ID NO: 31471 - DNA, 201 bp, Homo sapiens
ttttgaatactgggctcaagtgattatcctgccttagcctcccaaagtgctggaatttcagaggtgagccactgtgcccagcctcctgttttttttacatrtatatatatatatatatatatatatatatatatatatatatatatacacacacacacacacacatatatatatacacacacacatatatatatacacaca

SEQ ID NO: 31472 - DNA, 201 bp, Homo sapiens
taagacctgtgctttttcatataaattgtacaatatggttgtctatgtctaccagaagccttgctgcagttttaatggggtttaaatctataggtctaacrttaaacctatagatcaattcgggagaattgacatctttactatgttgagtcttccagtttgtggacatggtatgtaattctatttatttagtataaaccc

SEQ ID NO: 31473 - DNA, 201 bp, Homo sapiens
tgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtg

SEQ ID NO: 31474 - DNA, 201 bp, Homo sapiens
ctctcctcacccactctgtttcttttcttttgagcacttaccactttctgaatatgtatacaattgtttcctcgattactgtctgcctcttcttccctagrgcgtcagcccatgagcttatccagcctacagaggagatgctgcagcttggcagagcatggattgctcaacataccagagtttagtcctacctctgtctcc

SEQ ID NO: 31475 - DNA, 201 bp, Homo sapiens; identical to SEQ ID NO: 8639

SEQ ID NO: 31476 - DNA, 201 bp, Homo sapiens
ctttgtagttcttgggtaggtgtgtgactgtggcctatgaggccaagttgcaaggtctttggatgaactttgtggcatctggcaatgtccccagtgcaacytatgtaaaatatagcagtttcctgcacacgcttaagggaagaaaccgttgtggggaagcgtgctctgttattcttgccaatgtagccaacatatacatgg

SEQ ID NO: 31477 - DNA, 201 bp, Homo sapiens
tgctgagagtttgaatagtatgtgaagtctgtagagacaaaattgttgttttccccagttgtaaagtgtgcaatattatccttgcaaaattgtctgtttawtttttttgcccttttgggggacaaaatgtctttatgttaaattgttttattattgttatctttatggagttaagggcacataaaatattcttacagagag

SEQ ID NO: 31478 - DNA, 201 bp, Homo sapiens
caaatggtgcatgaaatgaaaaattcctggtggtctccaggggacacagccggtgctgtgctccactctgggtaactgttttggattattttctctattcyaactgaaataaaaaaaaattaattaaatgtggctaggttatcttgacagcagaatccattcccagttaattattattttaatacttgatggtgtctgtca

SEQ ID NO: 31479 - DNA, 201 bp, Homo sapiens
tggagctcagaaaggaggagaaaggtccctgctggtctgtggagagggccttggccaccagagggatcaaatggcccaggcaggaaataagtatcccgctytcagatctgaggccagattttcaagtgtatgcatgattctggggtgctacaaagggtatagagtatggagttagaacattacacgtcaacaagaatatgg

SEQ ID NO: 31480 - DNA, 201 bp, Homo sapiens
ctatgtctaccagaagccttgctgcagttttaatggggtttaaatctataggtctaacattaaacctatagatcaattcgggagaattgacatctttactrtgttgagtcttccagtttgtggacatggtatgtaattctatttatttagtataaacccactggagtgtgtacctaagcatttcattttctttggagcgat

SEQ ID NO: 31481 - DNA, 201 bp, Homo sapiens
aggacattgttttaagtgggaaacgtcagctctctcaacttctacacattcgactattccctactcctcagtgaccccaaagaccccagagaaactcagtrtgaaaaatcactatggaagtgcaatagttattactttgtttggaattcactacaacactgtttctcaaaatataattcctgagtcacttggaagattaca

SEQ ID NO: 31482 - DNA, 201 bp, Homo sapiens
ttactttaattccccctacaagaatgccgagacacctctgcctattttctctttctgtgtttgttgtttcttttgtttttgttttcgagactgagtcttgstctgtcgcccaggatggagtacagcagtgcaatctcggctcactgcagcctccaactcccggctccagtgattctcctgcctcagtctcccaagtagctg

SEQ ID NO: 31483 - DNA, 201 bp, Homo sapiens; identical to SEQ ID NO: 14865

SEQ ID NO: 31484 - DNA, 201 bp, Homo sapiens
gtgatcaaggctcactgcagcttccaactcctgggctcaagcaatcttcgtgtttcagcctcctgagtagctggaattacgggctcatgccaccacacttrgctacttgtttaattttttgcagacatagggcctcactatgttgcccaaactggcctcaaattcctagcttcaagcggtcctcctgccttggtctctcca

SEQ ID NO: 31485 - DNA, 201 bp, Homo sapiens
ggcactggtgacagtgaagactcagatgaggttcttgagtactttcaattaggtttaccactgaccccatcagtgtgcagacgaagggagatgagagatamagatggttaatgggatttttggggtatcttccagcctttgtgagcacagaggtttcgctacattttgaaaattaaaattcatttcattcgcattacagat

SEQ ID NO: 31486 - DNA, 201 bp, Homo sapiens
gaactctgattttgaggaaaaaggatagggtaatggtgttgacacaggcactgttgaatacgtatgtacatattttaatagttttctcattaatcaaatgkaaatgctatcgattttataggatcgttgtgagaagaagtgagaattgaaatgaaaggcatctagtcttccccggtccccatccacttgacccaccatacc

SEQ ID NO: 31487 - DNA, 201 bp, Homo sapiens
tagccccattttgcaaatgaagaggctgaggctcagaaatttaaaattgcttcatgtcgcacagttcagtgtaaagttgcaatgcaaactaagatgtttcygttgcttataatcttaactataataatcataaaccatgttctgttgctcagaacccttgtacttataatataaaacaatctttttaaccaagattcttcg

SEQ ID NO: 31488 - DNA, 201 bp, Homo sapiens
caaggtaatggacatgaggcaaaaatttaaggaaatgacaaaaacaagagtatttccattttcagttaagtgtatgtactgatgttctggaattcactatragaagttgcaaatggtgcatgaaatgaaaaattcctggtggtctccaggggacacagccggtgctgtgctccactctgggtaactgttttggattatttt

SEQ ID NO: 31489 - DNA, 201 bp, Homo sapiens
aagcagggatcattctggagtgtacactgggcatttgattttaaagcaaatccaagagatcattaaatttgtatcaatgaatacactgttacccctcaatyaacactacaattcatatatcagaatagcactttgttacttgtttctgagatagggctggctctgtcacccagactggtgtgcagtggcacgatcacagct

SEQ ID NO: 31490 - DNA, 201 bp, Homo sapiens
atgtgaccttttgtgtctagctccgttcacttagcatgctgtttccaaggcttgtctaagttgtggcatgtgtcagtactttattcttttttatggctgcrtagtattccactgcatggatataccacatcttgtttatctgttcatccattgatggacatttgggttgtttccgccttctaggtataatgacttgtgttg

SEQ ID NO: 31491 - DNA, 201 bp, Homo sapiens
tttccactgactaatcaggctgataaaacaacctgaaaatggctttcccatggagtttatatatttcgtcagagacctaaaatggtataaatgttcaatartagccagtgaatataaaactaaataatccatatgagacaaaacaggtagaagaaaaaaacattcctcctcagatatgcaccttttaattgaataaagcaa

SEQ ID NO: 31492 - DNA, 201 bp, Homo sapiens
gagcttgcagtgagccaggatcgcgccactgcactcccgcccgggtgacagagcgagactccgcctcagaaaaaaaaaaaaaaaaaaaaaaaggaaccagrtggccctgcccttgagcaggctgtggtctggcctggtggagagacagagaatcagttaattccagggtcatgtattaggtagtaagatagtggttcacac

SEQ ID NO: 31493 - DNA, 201 bp, Homo sapiens
ctttttttttttttttttttttttttttttgatacaatgaggggaaatgtttcttccacaaaagcctggccgtttgtctttaaaaattttcatcttttggstactgagttgtaatagtaaatacagatgtagctgtgtcacattaaaagcacaaccaaattgtagtacaatgttcaggacacttttatgtcactttaaaat

SEQ ID NO: 31494 - DNA, 201 bp, Homo sapiens
aggggacccttggtatcctgttcatctggcaaatctcagcaccaatagaaacaccaagaacatggattcatcaaaggaaaaatgttgaagtttccattttkatgcttcctggtaatccttcagcccttgatggaaatttccagacctaaaccagtgaattaagagtatggggaagaggagccctcatacagttctgttaaa

SEQ ID NO: 31495 - DNA, 201 bp, Homo sapiens
aaggtcacttgaacccaggaggtagaggttgcagtaagctgatatcatgtcaccgcactccaacctgggtgacaaggctagaccctatctcaaaaataaasaaacccttgctattttagcttccgatgaggatatttatccttctagcatttgaatgcagccaaagtccttactgggcaaatttttgagctctcaccccac

SEQ ID NO: 31496 - DNA, 201 bp, Homo sapiens
cgagacaatgtctcaaaaaaaaagaaagagttctgaatgatgataggtgttggaatccacgttggtgtgtctcatgtcattttttcgggcagtttcttgamagacccattttgtgtgtgtgtgtgtgtgtgcgcgcgtgcgcacacgcatgagcctgtacgtgtccccctccccccccacacatatgcacataagatagca

SEQ ID NO: 31497 - DNA, 201 bp, Homo sapiens
tataattgtcattgaagtcaaaactgatggcgtaatatttaaaacaatggctggatccccaatctaagaagaatacattttgttgatcatattaagtactsttacagtgaatgcatggacccatacaattgtggaataattaagaaaaaaggacttaagggcttaaaaatgtctttttaacaatttaacaagttagccaga

SEQ ID NO: 31498 - DNA, 201 bp, Homo sapiens
tcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccaccaa

SEQ ID NO: 31499 - DNA, 201 bp, Homo sapiens
catcaggggagccaagtggacgctaatcaccaccgtgcctggagagttgcctttcagctggtgaatttactattgccaactcctgcattcttattagtctrtaagattgaggtcgtttattggtgatcacttgtagatatatatttatataaatctcttagcccagaatctccataaactgtttttcatgatgtggatacc

SEQ ID NO: 31500 - DNA, 201 bp, Homo sapiens
ggaagctggatgatgggtatagggtgttctctgtaccagtttggccatgttttgtgaatctataattagtttcaaataaaagttaacaaccagaagatcaygagctaaaccaataaagtgaattatggtcagttgcagattcactgccagacctgggaggaaatctcaccttggcagatcgagtctcttgtcctcgcctaa

SEQ ID NO: 31501 - DNA, 201 bp, Homo sapiens
aagctatattgattttgtatttctgggctcagcttttgactcagtctcattccccagaaataatccctgttaacatttcggtttgtgttatggaagtgttytctcttctatgaattagctaatgcccataccatacatatgcctgcatttgtacactcttaagccaaataacatcgtactgtgtattattctctagtagcc

SEQ ID NO: 31502 - DNA, 201 bp, Homo sapiens
catccttaataatacttgatattatcggtcttctaaattttctgtttgggtacatagtggtattttgttgtatatatttttttaattgtgaaatatgtgastatgatgagtaatgattttgaacatgaaaactatgcttattgctcatatctatgttattttattatttactttttttgagatggagtctcgttctgttgc

SEQ ID NO: 31503 - DNA, 201 bp, Homo sapiens
acttaaaaaatttttctaagcaatgatgtcattgtattttacttataatcagaagtacatcagcccgtgaatttagttaaaggtttttaatgtcacttttrttacatttttactgtgcattcatgtgcacacacacacttttaagcatttttgatttatatatccctctgcatattttgtgccttgtgatgtgtttaacga

SEQ ID NO: 31504 - DNA, 201 bp, Homo sapiens
cagctaggaagtagcaaagatggaatttgacccaggtctgactccagaagcactttcctcttttgcctcctaatacattttcttatagggagcatcctgcwatacaactgttaagaccacttaatgttatctttggattaaaaatggtaccactctcataaatcaatgagtttcataccctaaattatgccagattaagaa

SEQ ID NO: 31505 - DNA, 201 bp, Homo sapiens
ggttcccacaagagagaagtagacagagacctctggaagtttaaaaatatatatgttgggatttcatagatgaggtgagcaaaaaattggccgggaagaamtattaaggaggagatgatcagaaacattttcaaaatacctggaacaaacaaagaaccacatttcaagaaaaagacagagaaacaagactagcaaatagag

SEQ ID NO: 31506 - DNA, 201 bp, Homo sapiens
ttagagacaaagtgttttacttatggccagtagatggaattctaaggtccgatgtcggtttgccatgacttgggcattggtttctgttcggctctgtttasggggctgtgggatgggtacatagacactcgtctacttgaacttccagggactcgggaggcctgcagttgaataacaagagaccgtgctggtgagaggtgg

SEQ ID NO: 31507 - DNA, 201 bp, Homo sapiens
caagcgattcttctgcctcagcctcccgagtagctgggactacaggcacacgccaccacgcctggctaatttttgtatttttaatacagacagggtttctmcatattggtcagggtggtctcgaactcctgacctcatgatctgcccgcctcaaagtcccaacgtgctgggattacaggcatgagccaccacgccctgcta

SEQ ID NO: 31508 - DNA, 201 bp, Homo sapiens
tctaacatttgctgagatcctgctgtataccgggaacagaacatatatggtttcatttcatcctcccattatcaccgtgaggcctcttccgcttatctatkgctgagtaacaaggtgtacccctcaatttactggcgtaaaacgacaacagttttattacatctcatgattttctgggtcaggactctggatagggtttgg

SEQ ID NO: 31509 - DNA, 201 bp, Homo sapiens
tctgcgtaactcggcctcccaaagcactgggattacaggcttgagccactgtgcccggccatctttctttttcttcctctccttctaccttgcccaccatrgcttaatttcaccagaatatcatcattatcaacatcattatttctagttcagatcattctaaaaatagagcagtcattttcttctatataagtcccaggt

SEQ ID NO: 31510 - DNA, 201 bp, Homo sapiens
ttttcactaggtttaagtgagaatatttgtgagcaaactctcagtgtgggcaggtgacaatttctgcaggtattttccccccattttaacttgtgcgatayagttccctattttgttttgttccgcctcgatcacaacagctgccacccgaggtttaaagatactgttgtcctcatcttcagaacaagggttacgtttgct

SEQ ID NO: 31511 - DNA, 201 bp, Homo sapiens
acacagttgttcacaaacatattgatatcagaccttatagcagtcctattggctagatcagttattatgaatgtgttttatagagtaggaaacagagatgygacgtgacttgcctaagaacacacagcagttctgaaactcaccctgtgctaatctgacctcgtgaagaaattgagcaaactaggctccagggagaaacga

SEQ ID NO: 31512 - DNA, 201 bp, Homo sapiens
actttgcagattttgctttcaaactctctagctgcggtttgagtgattaatttcaggatccatcctatttcttagaggaagccactctgatctaccctgtygtctctttatattcaagatatcctttatagagctctcaaattacttttgggaagaaggagctatttaataaaatacaacttaagtgaaaacacattccat

SEQ ID NO: 31513 - DNA, 201 bp, Homo sapiens
tgcacatcgttatttattattactgttattattatttgacatggagtcttgatctgttaccaggctgcagtgcagtggcatgatctcggctcaccacaacytcagactcccagggttaagcgattctcctgcctcagccttccaagtagctgggaccacaggcgcttgccaccacacctggctaatttttgtatttttagt

SEQ ID NO: 31514 - DNA, 201 bp, Homo sapiens
acacaggactcccaccctctacttccaccccaccaacaaagaatgattcagcccaaaatggcagtagtgaccttgttgagaaatgctgttcaagccatacrtcaccattggaaggttgccaaactgtgctttgcacacacatgctgtctgcacgccttgtatttttctctttgcttagtcctgctcatgctctctaaacac

SEQ ID NO: 31515 - DNA, 201 bp, Homo sapiens
tctctgaactaaggctgtatctaattacaaggcattgtatcggttctgatttattaaccatttacttggctttggagaaggcagcatttttagtagtactrttgagcctgcatgtagcttttccaggagggcagggtgcctggatatctgatcttacagttattactttgtgtcatatataattttgttttctccctgcaa

SEQ ID NO: 31516 - DNA, 201 bp, Homo sapiens
aacggggagatggccatgattgcttttagattgccacttccacattgagtgaattttataataagaagccattttttccccgacaggctgcccttgtgccygcctctctgactttgaggtcctcattattgtgggtttaaatgaaggatgttcattcaggcagggatggggggatggggggaggccaccaggcatcagcgc

SEQ ID NO: 31517 - DNA, 201 bp, Homo sapiens
gaagaggcacagaagttcagggcgtgagagggtatgcgagagatgtcaacaatccaggagctggcttgcttcttcctttagtcagtggtgcaagcttcaartggataattcaaatgaatcaatggaaaggcctcttttaacatttgatttgtttcttcaaagaacacagatgaagtttttctcatctctttagattagtga

SEQ ID NO: 31518 - DNA, 201 bp, Homo sapiens
tagtttagatactttccttttacatatatatttcctgatcagcttctccatttcttttaaaaagccttgctgggagtttatttgctttggtattgaatctsttgatcaatttgaggaggatcaaaatcctgaaagtgttgagcgttaccatccatgagcatgcatctctccatttatttaaggcttctttatttataaaca

SEQ ID NO: 31519 - DNA, 201 bp, Homo sapiens
atctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggct

SEQ ID NO: 31520 - DNA, 201 bp, Homo sapiens
ggacacattgattccacaacactgaccttctatcagatcagccaggatgctctttttcaaacttctgtcaatctttccccaccttcacaatgtgcccctaktattattaatatttaaaatattgaagatctaattaatgttgaaatttttctttaaatcaattcatagattcattaactttgttttaaaaggaaatgttct

SEQ ID NO: 31521 - DNA, 201 bp, Homo sapiens
ctccctctccccaggagaggtcccagcggaataaacatccccgccccttcaactctttgccattgttcaagccctgctagaaaccagatggcaaaaggaasttactgatgtgttcatattggtcaactttttcaggcacgaagaccagtacagaaggatggaaagtgcatttgggtagggaaatgggagattcctgcatag

SEQ ID NO: 31522 - DNA, 201 bp, Homo sapiens
aattattcttttacccagacacttacatattcctagccattccttttgcttaagtttgcagagatttgtgcttaaaactgaataaacaatctcagggtttktgtgtgtgtgtgtatgtgtgtgtgcgtgttatatgaagtcttgctagaatgcataaacaaacaaaaaaaatatcatactctcagatcctggatactgtgg

SEQ ID NO: 31523 - DNA, 201 bp, Homo sapiens
tgggaatacaggcacccaccaccacgcctggctaattgtttttgaatttttagtagaggcgagattttcccgtgttggccaggctggttttgaactcctgmcctccggtgatctgcctgtctccgcctcccaaagtgctgggattacaggcgtgagccaccgcgcctggcctgaattaatattttctaccccactttctta

SEQ ID NO: 31524 - DNA, 201 bp, Homo sapiens
atccactggcatgagtcatctttcccattggtagattgcagagcaaacttctggacagatttgcccttggctcatgtatgattggacctgcggtctgtccmggtgtactcagagtggggaaggggagcggtggcaggtaatacaaaacccacctaagtagaaggacctatgaaccatgagggttttccttagcagggagtg

SEQ ID NO: 31525 - DNA, 201 bp, Homo sapiens
cccagccaaaattcattattttaagctgtacaattgagtgatttttattacgttcacaaagttacgttaccattaccacttttgaattgcagaacaatttmatcactccaaaaagaaatctcataacaattagcagttattttccatcgctacttcctccagtcccaaggcaatcagcagtctgctttctatctctacctg

SEQ ID NO: 31526 - DNA, 201 bp, Homo sapiens
ttctgtagagatgaggtttcaccatgttggccaggctagtcaactcctgacctcaagtgatctctccaccttggcctcccaaactgctggaattacaggcrtgagccaccctgcccgaccctttcattttaaatgtgatagaaacagactcagagaatgtgagtgactttcgcagggtcacttagcaggttggtgacgggc

SEQ ID NO: 31527 - DNA, 201 bp, Homo sapiens
cagctgtcaacaggcatcatttttggtgggacctgaagatgtatatcccttgttttcagattcctcgcctctcatcatgtaaggtgatgctctgagctggktcttaaagcttctgggcacagccccccttgagtcttcattatggcaaatctagtgcaggtgctgagaggcggtaactctttaaagggacaggatatggaa

SEQ ID NO: 31528 - DNA, 201 bp, Homo sapiens
atactctggggagaagaaaggatcagggtcgggtggggacatctgtgggcatattggggagggggccaggaagaagccaggaagggggcatgctgtcattygtgggttttgcaactttctgtggcatagaaggcatagaaggatctcttcatttaaaaggtcaggttggattttttttttttaacttcaacaccagttaac

SEQ ID NO: 31529 - DNA, 201 bp, Homo sapiens
gtttcttgtgataggttcaattctcaggctccttctcattagagtctttctgtaaagaccattattatttctgttatatttcctgtggctgagctgagccrcacttggagatttgatccattttaactctctcattgccttcagagagttggtgattttggggggggcaccagtgtgagtcctttgatccttgaatgacaa

SEQ ID NO: 31530 - DNA, 201 bp, Homo sapiens
gaagcccagctagccatgtggagaggccttgtggagcgggaaatggccaacctccatccattggaagtcatcccatttgaggccctagatactgaaaatcrgaaagaagttacttcccattccccacctcaaggccctgtccaaactgaagattcatgggcagaataaacaattgctattttttaaaggtgtatgtttggg

SEQ ID NO: 31531 - DNA, 201 bp, Homo sapiens
gacatgaaaggggcctttctcctgctgtcatcctgaacctctgtctttcaaatttggatgtgtcgggggccacaggacactactgtgcatttgcctgtgayttgccattgggttggagtacttctcctgagtttctgcagtgttctaggtatggtcttaggccctggaataagacagtgtaggaaacacagaaggtgcctg

SEQ ID NO: 31532 - DNA, 201 bp, Homo sapiens
tttttgaagaatggcgctctttaaaaaaacataagggaactttttttttcaaacactgtaatgagggtattcaagtctgcaggcaaaacagagctgtttgraaagacattagcctcgaaaccgcactgtgccagaatagatacagctacgtcaaaatgccgcatttattttgccattacttttcactgactaaaaccattt

SEQ ID NO: 31533 - DNA, 201 bp, Homo sapiens
tgtcacttggttgttctcggtttcaggacccacgtcttttgtctctgtaatgaatgtgttcagaggtctctgcacagagaagctggctgttaggaaaactwtttcttctttccgagacaggctgcaaaatgcttgttactattttgtgtattcctggcaggatttgtattcttagttttattactaatgataataacagtt

SEQ ID NO: 31534 - DNA, 201 bp, Homo sapiens; identical to SEQ ID NO: 4887

SEQ ID NO: 31535 - DNA, 201 bp, Homo sapiens
gaattttctcctttgtcttgtctatttattccttaatggtatcttttgaaaagcagaagttataaatactgatagtgtccaatttatctttttcatttgtktagtgctttcttgttctaagaacctttaccaatcaccaggtcacaaaaatattttcctatgttttcttctagacactccataacttcaatctttacattc

SEQ ID NO: 31536 - DNA, 201 bp, Homo sapiens
tcatctctataaaaaatttacatgaaaaaaaataaacaaaatacttctgcaacagcagcagcaagagctgccgcaatgaaagaagaaagaaaaggagggasaggatgaaggaaagaagcagtgttaacattctagtaatatttgcatctgaatgatatttatatggggttattgtcctccctttgtgtatgtttaaaattt

SEQ ID NO: 31537 - DNA, 201 bp, Homo sapiens; identical to SEQ ID NO: 8640

SEQ ID NO: 31538 - DNA, 201 bp, Homo sapiens
gaaaaaataaagttttaaggctctagaattggagtgactcagctttacttgaaaaatcccagaatagtaggaccatcatttagaagtttcgagacgataayattagggaaaaataacagcaaatgttacttgatagacactaaactctggggcatatgagatgacccaggctggaaaaccactggcttacataaaggtatt

SEQ ID NO: 31539 - DNA, 201 bp, Homo sapiens
tggcctgttggccatggtcctgggcgcaaagagcagaaaaggacgagacggggactgaacagacttgcttagttcctgacattcaaggaagaactttaacrtccatccacggagcctcaaaggctaaaaataatcatccctttcaatagttcctgttgtgaggaccattaacaaattataagagaaagcattcctcacttg

SEQ ID NO: 31540 - DNA, 201 bp, Homo sapiens
gcagagttattcctcaagcccctggactcgcagagaatcaggtgtatgaagcaagaggaagaagacaagaatcaggaggcaaagagaaggaggaagaagcstcagtggggttgcttctttttatttcttagagccagagctggaagacaaggcctggcatattttggcaggcctggatcagagcctaggtgtgtaaattag

SEQ ID NO: 31541 - DNA, 201 bp, Homo sapiens
ttcctgtgcatatatttttgtgtattccgggaggattttcttttctttttctttttaatcctcctcctcaagggaaacattcttctcacaatagcttcctrgtagaaagttctaactaatgactttaatcgtgtgaatgtattgcagaaatggacaggacaattctcagcccattcatcttacagacctcaagtgaacagg

SEQ ID NO: 31542 - DNA, 201 bp, Homo sapiens
cagcagtacattacagggacagtggttgggtctggagatgtcacccttagctgtttttcacaatgagaggttgttttatcataaataaatcaataaatggyagattatacaccggagttactgagaaatataaaaaaaaaaaaagcccacattttaaagggaatttggtatttttaacaaagcatcagggggccgggagca

SEQ ID NO: 31543 - DNA, 201 bp, Homo sapiens
agtgtcagcatcacctggtagcttgttagacatagaaattcttgggctttattccacacataatgaatcagaagcttatggggtggggcctgcagtctgasgtttattttttctaaaactttaagtttcagggtacatgtgtaagatgtgcaagtttgttacataggtaatcatctgccacggtggtttgctgcagagatc

SEQ ID NO: 31544 - DNA, 201 bp, Homo sapiens
catggaacctcagactgggatccttgacttccttatctataaaatatggcttataactcaccctgtattatagatctgctgggaacatgatagaacgtctraacagtgctggcttatagcaagtgttcagagatgtgtttcgttgtttttcttttttctttttttgagatggagtttcactcttgttgcccaggctggagt

SEQ ID NO: 31545 - DNA, 201 bp, Homo sapiens
tgaaaggactggcaagtgcctctgtgctgatattgtacctgggctcagtggtctggctaaaggagaggtgctggggccaggtgacaggcgagtctctatayggcaggcccaaaaaatggaggtgcaggcttcatctatactttgatgtgtatgcttccttctttaaacttgtgataatcagagttatagctgctttaaact

SEQ ID NO: 31546 - DNA, 201 bp, Homo sapiens
gagcactgagtgtaactccaggtcgggtatattatgtccctctgtgttctctagctagttatctatccatccatctcttgccttgtccacagaagttacakgtaggctgccgggcgcagtggctcacgcctgtaatcacagcactttgggaggccaaggcgggcggatcacgaggtcagaagttggagaccatcctggcta

SEQ ID NO: 31547 - DNA, 201 bp, Homo sapiens
atttggtagcttgactggggaagaattggcttcccaaatcacccagattactagcagactttatttccttgtagctttttgactcggcctggcttcttgcygactgttggctgttggctggaggtacccctcagctcctagaggcatcaacagttcctgaatatctgggcttttcccacaaagcagcttccttcatcaagc

SEQ ID NO: 31548 - DNA, 201 bp, Homo sapiens
ttatcccttctgttgatgcaattaaagctaatggatctcatatatatatatatatatatatatatatatatatatatatatatatatatatatttatatawatatattttatatttaaaaatatttatattttatatatttttatatatttatgcaagtatatatctaaatatataaaatatatataaatatatacatata

SEQ ID NO: 31549 - DNA, 201 bp, Homo sapiens
ttgattgcttctcttcccattgtttatagatacccattctcgtaatgatggcactgtgtctgtcatagaaggcctaattctccctgttaacattgaacatraaaacctcatatgggccaggcacagtggctcatacctgaaatcccagcactttgggaggctgaggcggatgaatcacctgaggttgggagttcgagacca

SEQ ID NO: 31550 - DNA, 201 bp, Homo sapiens
gcccaggcgaggatgaggagtaactgagctgcagaccattgtttagccctccttccacctgggagactggctgctggttctcattgcttctgtgggtctcyaggtttctatcattacacagattagcacacggttccatgatcatggacccgttcagtacacaatgaaatcatttgcaaagcaccttggggtctgttagag

SEQ ID NO: 31551 - DNA, 201 bp, Homo sapiens
tgaaggacgctattttaatggggtgatttttttcttctcactacattcttgctcactccccactttttatgtccggtggccataggctggtgagaacttgrttttgaacagttgaaggtctgctgttagggacgtgctaatctagggaattgtactgaactcgtgggagcatgttagtatcagatgtgtgccttgtccgtc

SEQ ID NO: 31552 - DNA, 201 bp, Homo sapiens
tgcgtggtggagctatgtactaactggggggtcttgaggaagcccattagtctccctgagcctcagtttagtagaagtaggaatcgtcattaaggcgcctmatttatgaagttactctgagctctataagagataagcatacagaaaactttggacagtgccttgcacacagtcagtaatcaatgcatattcatcatgatg

SEQ ID NO: 31553 - DNA, 201 bp, Homo sapiens
gatttatactatggatcagcagcctaaaccctgcaaactgggtcccccatctaagagtctgcagtgaaacgcgagccgacttgatgtgtctcagagtgatsattcttgcccttggcggttgatgctagactgttgcagcttcaaatataatgtattttagtgctatacgacagccataagtattggcctgtgtccactggt

SEQ ID NO: 31554 - DNA, 201 bp, Homo sapiens
agaacggatacggttaggaccaacatttaggcaatatgaccgtgtacaggattctaccaccatcgtcaccatcagtgttactgttccctgccatctgcctrtggggtgtctaccatctaaagttcagcactgcactgggcatttttaaattatcattagtatataattatatataataataatttaatttataactatatc

SEQ ID NO: 31555 - DNA, 201 bp, Homo sapiens
attgacccagcagtgttcattttcccataaggtggtgctggatagggataggatgtcgccccttgttcaccccttggcaataatctgtttgattcactccwaatgctgcttctgatctccatctatttcaggggatgaccagtctgaataaaaccaatgagcttaatctacttgtggaatgttatagccggaagggattca

SEQ ID NO: 31556 - DNA, 201 bp, Homo sapiens; identical to SEQ ID NO: 14866

SEQ ID NO: 31557 - DNA, 201 bp, Homo sapiens
tatatttttaaaataaatttgtaatcatgtatacagtagtccccccttatccgtggtgtttcagtttttttttttttgagtcagagtattactctgttgcscaggctggagtacagtggcgtgatctcagctcactgcaacctttgtctcccagggcctggtgattctcatgtctcagcctcctgagtagctgggattaca

SEQ ID NO: 31558 - DNA, 201 bp, Homo sapiens
accatggtggaaggcaaggaggagcaaagtcatatcttacatggttggcagcaggcaaagagtgagcttgtgcagggaaactcccccttataaaaccatcmgatctcgtgagacttgttcactatcacgagtaaagcacaggaaagacttgccctcatgattcagttacgttccaccggggccctcccacaacacatggga

SEQ ID NO: 31559 - DNA, 201 bp, Homo sapiens
aatctttagtgagtacctgtcacaggttgagcagtcttctagggcctctggttaccagcaatgaaaaaagccccatttggtaaaatacagtagttggattmattatctctgtgattaacttgcataaaaaagagacagttttcattgatgtgacctttagcaacaactcctaaaatattttttttccttcattcctgcttt

SEQ ID NO: 31560 - DNA, 201 bp, Homo sapiens
taaataaaatattaatttttcatagtgtttaatatgtgccagtatatataaattcaaggtaaggtagacagctgtaaactggatcccctgctgtacccagsaaatgctgagagccctgcttcccctcttgtattcaaatggctctataagagaggaagtagtacagctatcagtaacaatgccatccggtaattaccgaat

SEQ ID NO: 31561 - DNA, 201 bp, Homo sapiens
gcccattgaattttgatgatagcattaaaacaaatgcctcaaatcatttttggaaggagacaggatatgaattgacaaattaataaaataaattatacttsaaagatgctaaattatctcttctatgtaagtaggaggctctcttttcagatgtggaatttgtaggagcttgaatattctcaagagagggtatgggcaaca

SEQ ID NO: 31562 - DNA, 201 bp, Homo sapiens
atatgcgtatatatatacgtatatatgcgtatatatatacgtatatatacgtatatatgcgtatatatatacgtatatatacgtatatatatatgtgtgtrtatatatatataaaaatatatttaaataatgttaaggctagagtagaatgacatcatgggaaggcttattgaaacttggagtggattcgtagtctgccac

SEQ ID NO: 31563 - DNA, 201 bp, Homo sapiens
cagtgagactactatcattcattttcactccccgtaaacatcttctgtttctgttttagaagacattgctaatcccctcatgcactggctttgcgaatttmtttttcagcctgggtttgaaagcaaagtggtagtgactttttcctgatagctgctgaaaaggttccacagtatttggaccgctgcctgcttctaccctgg

SEQ ID NO: 31564 - DNA, 201 bp, Homo sapiens
cagcaaggtctttatgacctgtatcttgtgctgacctcctatgttatcctgtaacttagaatgcctgacctcgtgggaatgcagcccagtaggtctcaatsttattttacccagcccctattcaaaatggagtcactctggtttgaatgcttctgacaaacctctgagactaaggacaagatggagtctgttaggttagtt

SEQ ID NO: 31565 - DNA, 201 bp, Homo sapiens
tctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtcta

SEQ ID NO: 31566 - DNA, 201 bp, Homo sapiens; identical to SEQ ID NO: 4896

SEQ ID NO: 31567 - DNA, 201 bp, Homo sapiens
agtgcttatagtttttgaggaatcagtgagaaatgtcatctgaatgtctcttctcaatctttctgaaagataacttgcctataaacataaaattaaaagcytgctgtctgcttagttcaggtattgggtcagcgtcttgtgactatggacaagaggtgtttgactctaggactcagctacctcatctgttaaatgggcaaa

SEQ ID NO: 31568 - DNA, 201 bp, Homo sapiens
gtccacatagaaaaacctgtttctctattttgttttcaaaattatatcatctttataataactgttagtacctagaaaaatgcatacattttattccttascaaaaccagttaccctatagtcaaaaggcattcagaagtattagcagaaatgtagtcagtagccaggcatagtggctcacacctgtaatcccagcacttg

SEQ ID NO: 31569 - DNA, 201 bp, Homo sapiens
gttttcgagactgagtcttgctctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggc

SEQ ID NO: 31570 - DNA, 201 bp, Homo sapiens
agtcctaggcttggttacaaagggcaatgaagggtcttttctgtccttaagcactcacaggtagcttaacagtaatgccttggattccttccttcaagagygacagcaggaagcccagcttctctggtagcagagcaggggtcctcaaagcagaccgtgaggtcagaggagcactggagtcaggagtttccatctccaccc

SEQ ID NO: 31571 - DNA, 201 bp, Homo sapiens
gccctccggggggtggggtatcaagggagagtatgggctttgaaactgctcatcccgtctacaaccttggagggcatggtgtttcactcccccacctctcyccacaacttcaccctgctccaatgaggatgaaaatgtctttcttatagatgggacaggagccttagtaatatggtgcgagcaatggttcacataggggac

SEQ ID NO: 31572 - DNA, 201 bp, Homo sapiens
tttgagccaggctgtggatcaagatgaaagaaaaattaaattgtatattgaagagctcttaattgagccatgctgtatttaacagggaagcatcggcttcwggcagtcgataccactgaggatttttaatgccctgcatcatgagactgtcagtttgctttggagaatgcaaacaggctaatgacaaagccctgcaaactt

SEQ ID NO: 31573 - DNA, 201 bp, Homo sapiens
ctctctcgaagctccatgcccaccttgctgttgcaccccccaccccaaggaaagccttcccacctttggaagctgcattaattcttccaggccacaagggkgccgttgagttactggttcactgcactggctggcaggaaagagttttaatgcaggctccaaaggtgcttaatttcctgtggtccttatgaatatgcatac

SEQ ID NO: 31574 - DNA, 201 bp, Homo sapiens
ctggctaatttttgtatttttagtagagacggggtttcaccatgttggccaggatggtctcgatctcttgaccttgtgatccgcctgccttggcttctcamagtgctgtgattacaggcgtgagccaccacgcccggcctctttgcacattatttaagggtgttttaacaaaatggcaatttccccaggctggcttgtgta

SEQ ID NO: 31575 - DNA, 201 bp, Homo sapiens
gcagccaaggtcacagctggaaataaaactgtgtattccaaatcagaggggcaatgcaggaatggatcaaaggaatgaaggatcaagttgtcagccaagakaaccaagagccagacacagggaacctgtgacaaaaacgaaaaccaataaaaacatatattgagcattgaccaggtgcccaatattttaatgtcccatggg

SEQ ID NO: 31576 - DNA, 201 bp, Homo sapiens
gattgtaagtttcctgagacctccacagccatgccaaattgtgagtcagttaaatctctttgctgtataaattacccaggcttgcatatgtctttattagyggcatgagaacagactaatacagtcagggatgctgcagaacatctccaaacacacaggactcccaccctctacttccaccccaccaacaaagaatgattc

SEQ ID NO: 31577 - DNA, 201 bp, Homo sapiens
ccctcctaaccatgattatgtaaacaatagctgctaggcaacttgttgtttgttttatgcaaggcagtgtgctaagcacttacatacatgtattctgtctktagtttgttataagagtcctgcacacttaaccatgattatccctactttgcaaattacaaggttgcagtgcagagagcctaagacactttctcaacttga

SEQ ID NO: 31578 - DNA, 201 bp, Homo sapiens
ttgggagaaattgccacttggtctgtgtctacacagacccaagaggagaagggatttgacaatggtctgattaattgaatcagtggtttgggggagtgggstgtctgtattgatccaattaaatagataattgtcagaatcgaggtcatgtctataagacaccaccatttcaaagccaaagagattgtttcaaacatatca

SEQ ID NO: 31579 - DNA, 201 bp, Homo sapiens
ctagtgatgttagccttgacctctcggttaacgtggtatctgccagatttctccactgtaaaggatcatttttttcctttgtaattaataaatatattggrggaggtactttgggactacttctctaattttcatccattaattttagcatccctctggggatcttgcctgcaatgattaatactgtggtattctcatgac

SEQ ID NO: 31580 - DNA, 201 bp, Homo sapiens
gagccgagatcatgccactgcactccagcctgggcgacagagtgagaatccgtctcaaaaaataagtaaataaaataactaactaggctaggcacagtggrtcatgcctgccatcccagcactttgggagtccaaggcaagaggatcacttgagcccaggatttcgagaccaacctggacaacgtacagagacctcatctc

SEQ ID NO: 31581 - DNA, 201 bp, Homo sapiens; identical to SEQ ID NO: 14867

SEQ ID NO: 31582 - DNA, 201 bp, Homo sapiens; identical to SEQ ID NO: 8641

SEQ ID NO: 31583 - DNA, 201 bp, Homo sapiens
gcagtcacttaatgatattgaattgaacaccatttctcagaagttcctgtattaaattacaaccataagaacatacacaagcatgcagattgtaagtgtgwtgagaatggaaacattccataggacgcagagttattcctcaagcccctggactcgcagagaatcaggtgtatgaagcaagaggaagaagacaagaatcag

SEQ ID NO: 31584 - DNA, 201 bp, Homo sapiens
ttttgagaatcacaggcgtttttgaggctcatggctataatcccagcacttggggaggccgaggcaggtggatcacctgaagtcaggacatcaagaccagyctggccagtgtggcaaaaccccacctctactaaaaatacaaaaaaaaattagctgaacctggtggttcacgcctgtaattgcagctactcaggaggctga

SEQ ID NO: 31585 - DNA, 201 bp, Homo sapiens
ttgctggtattttcactcttccttcctaccctggatgctgatttgatgcttccagccttagcggttttcttgcttctaggactgaacagggaagagggaawagtcaaaagaatgacagaaggtcctcacgttgcagaacactgaccaatgttggcaactacaagacaatcaggcgtgattcttcatccaggatctgctttt

SEQ ID NO: 31586 - DNA, 201 bp, Homo sapiens
ctttattagtggcatgagaacagactaatacagtcagggatgctgcagaacatctccaaacacacaggactcccaccctctacttccaccccaccaacaargaatgattcagcccaaaatggcagtagtgaccttgttgagaaatgctgttcaagccatacgtcaccattggaaggttgccaaactgtgctttgcacacac

SEQ ID NO: 31587 - DNA, 201 bp, Homo sapiens
aagtttgggaacctctggcttaatcattatttatccacttctctgttgttggatgttagattgcttctagttcatatgtaattttataattttagttgacrtgtcattatggattcttgggcataaacgtttatatgaattttgaatattaggaaataatcttggaagctatattagttttctaaagctattataacaaat

SEQ ID NO: 31588 - DNA, 201 bp, Homo sapiens
gagacagggtgggcaccagttcctcaccgggtcctttctagttgcatgacctggggcaggtgactttatgtggctaagcctcagcttcctgacatatggcrggagtaataatatcccttgaagccaacaaaattcaataggcacatgccatgtacatgcctgtgttatgccgggaacttcttaacatttccagaatatgtg

SEQ ID NO: 31589 - DNA, 201 bp, Homo sapiens
aaagtgaacaggaacttaaagccagcagaggaaagctacctgcccttcactggtggtcagtgcatggattccagagacagggtgggcaccagttcctcacygggtcctttctagttgcatgacctggggcaggtgactttatgtggctaagcctcagcttcctgacatatggcaggagtaataatatcccttgaagccaac

SEQ ID NO: 31590 - DNA, 201 bp, Homo sapiens
ctactctatattatgtgggaaaaaaaaaaggagctggtggcagggggagagacttcaaattgagccagacctcaggcatgaagggaggggagagagggggraatgtggaggaagggggcgtttgtgcagtgggaagttggagaaagtacaaatgaaagcctctctgcagtgaacctcatgactgctttagagaggtgctta

SEQ ID NO: 31591 - DNA, 201 bp, Homo sapiens
gacctggcgtataattgtgggagggagaagccagtggagcagtcaggggactccctggctgtttctgtgtctggtcttatgggtctgggcactgaattcartcacaaaccctagcatgctcctttgctacctcaggggacaaagtcaagaaaataacactaggattgccaccctgctctctctctctctctcttttttttt

SEQ ID NO: 31592 - DNA, 201 bp, Homo sapiens
ttccccttctgaagtgaatactgatttttcgttacagatatttgatgctttgggggcctgttaaaatagttgtaaatacactttctaaatagatgaaatgwaagaaattctgagaaggggtttctttgacttactggaaaaaaaaataataggaaagaaaatgtgatcagttggtatatttggctctctttcatcaacact

SEQ ID NO: 31593 - DNA, 201 bp, Homo sapiens
ttagtcatcagacatttagatttcaacatgctcctgttaagctctccttacagtgtgtgtggcactgtgcagttgaatgaaacatgccatggccagtggaracaggcttgggctgatggagagggcctacagggccaggccttgaaggggagggaaattgttagctacacgaccaagagacagaagagaggaaggagtttg

SEQ ID NO: 31594 - DNA, 201 bp, Homo sapiens; identical to SEQ ID NO: 14868

SEQ ID NO: 31595 - DNA, 201 bp, Homo sapiens; identical to SEQ ID NO: 8642

SEQ ID NO: 31596 - DNA, 201 bp, Homo sapiens
gaggccttcctgaaatgtgttgtcaggcttgctcctgtgtgatggctggcactggttttatgctttccaattattctttgcacatcgttatttattattaytgttattattatttgacatggagtcttgatctgttaccaggctgcagtgcagtggcatgatctcggctcaccacaacttcagactcccagggttaagcga

SEQ ID NO: 31597 - DNA, 201 bp, Homo sapiens
agtcccagctactcgggagactgaggcaggagaatggcatgaacctgggaggcagaggtagcagtgagccaagatcgtgccactgcatcccagcctgggcracagagtgagactccgtctcaaaaaaaaaaaaaaaaaaaaaagataatgatgaaaataatagaatattgatgagaacacccattactctgctcattgttc

SEQ ID NO: 31598 - DNA, 201 bp, Homo sapiens; identical to SEQ ID NO: 8643

SEQ ID NO: 31599 - DNA, 201 bp, Homo sapiens
tgtcacatttaaaaatgaaatttttcttgaaaatgttcacatccttcccccagaaattctagatttataaatttctcccaaggaaatcattaggtgctacmtgaaagtttatgtatcaggtaatgatcacaaaattataatcacaaattaaaatagccataatgtctaataattcgacattagtgacagagatgatactac

SEQ ID NO: 31600 - DNA, 201 bp, Homo sapiens
ctataaatctttctgctataaagacacatgcacacatatgtttattgcggcattattcacaatagcaaagacttggaaccaacccaaatgtccaacagtgrtagactggattaagaaaatgtggcctttgcctcttttaaaaagttctaagttgctagccagtcggaacaaatacagaatgtgaggtccctttccagccaa

SEQ ID NO: 31601 - DNA, 201 bp, Homo sapiens
aaaggccttgctgggtgaggctggatttaatacatgttagggagatttctctttcacgtttgcttggtgtgtgtttggcggggggaacttacactcttagyaaagtagctagaaaaaaaaataacgtgcaaggggcctattttttcctccttcttctccgtcttaagtcctgaaatgttttagtgacccagaatgaagctt

SEQ ID NO: 31602 - DNA, 201 bp, Homo sapiens
tagaaatctggccgtgcctcttttggttaaaatttcaattaaaacatcagatggcacttttttcctattgccattaggagaatattcaattgactgaaaargacatttgaaaatttcctcgtattttcagcatatttgtttctagagttggagaaacaactatttgtctagagagaagtactctgaaaagacaaaggcctt

SEQ ID NO: 31603 - DNA, 201 bp, Homo sapiens
gactggtgtgcagtggcacgatcacagctcactatggcctcagccaccagggttcaagtgatccttccactcagcctcctgagtagttgggactacatgcstgcaccatcatgcctggctaatttttatttttgtagagacgaggtctccttgtgttgtccaggctggtctcaaacttctggaatcaagtgatcctcctgc

SEQ ID NO: 31604 - DNA, 201 bp, Homo sapiens
ttaaatgcaatagatgcagtaaagaaaagggttggcttaagagttgacttacaaagcttggtcctaacagctttttcctttatctgtttcaagagtcataygatatttgatctttcaaacttacgtatttcttccattatgtttagtattagtttcgttttctcaagatacatatttaacaactagcaaaatgttggaagc

SEQ ID NO: 31605 - DNA, 201 bp, Homo sapiens
aatttttgctgcccctgctacatacatgctttattgcttggaaacaggattacttggtgaaataatgtgaatctttcaattctcatgatacatgttttcamcttaatatccagggtgcaggaatatatattcccaccaactttatacaagataatacaaatataatagtatgaataaatatgctaatttgatagaaaatat

SEQ ID NO: 31606 - DNA, 201 bp, Homo sapiens
tgtgaacctctcccttaggagaagaacttttctttggcaaacaccataggaacggagaccttaacaaaagaattaggactctcttgtcctgttttaatctsaaagctgtccctgcgctggtgcggctggcccacttgtgcctttgtgaatttgcagagaagaggctgggcgtggggggacacatgactaatccgccctttc

SEQ ID NO: 31607 - DNA, 201 bp, Homo sapiens
gataggaccttggcatctcgtgcgaagcccctctgcctggagtcctgcctctgtgacacttgcttactgtgtgacctgggtcaactcatacctactgttcstcagttttctcatctgtaaaatggggattccagtggttattatgagaattaaatatgacgatacataaatagcacctggaaaagtgtttaggaaaccttg

SEQ ID NO: 31608 - DNA, 201 bp, Homo sapiens
atgagaattccactcctttgggagtattggcatatgttaaaatacaaatatatctgtatttttctcacttttattagaagagtgcaagtttgttcaaaacmactgctggattatctagtccctgaacagccatttatatttttgttacgcttgtggtttttaaatcatcctcatttccttgatcgcatttgcttctcctgg

SEQ ID NO: 31609 - DNA, 201 bp, Homo sapiens
ggcgggggcggtcagaggagagatagagcacttcagattccactcgaatacattagagcattagagcttttctcttcctcagggtgctctctctctctggsttgggaggagatgtggcatttctaggaattcacagtaaaatcagaaataattaggagatttcacagttgtagctcctgtgaagattcaggaatttttttt

SEQ ID NO: 31610 - DNA, 201 bp, Homo sapiens
tttctccctctggccaatgctccttcccctgtagatcatacccattcccaagatttcagtcatcaaatccattccaatatgactcctgtatccatatgtcyagttccaagtatctgtccatggtgttggtcccaggttattcgcacctcatatgtctttggcacagcactcttgacagctcataaagtcacgctgttaccc

SEQ ID NO: 31611 - DNA, 201 bp, Homo sapiens
tagtctcattttgtaaacccaattacgagcggagctacaatttttatctttgtttaatgtaaccaatgaggccattgtcactgtatggagaatagctttastccatattctctgttttttaagactctcagtctccttgcaggtgcctttggagagttaggtgtttgctgtgatttgagggatagtggccaataattttat

SEQ ID NO: 31612 - DNA, 201 bp, Homo sapiens
gtctgtgctggagagattgattccctggttatttatcttcctctgcccagtgtaaattggtcagcctgatcctattcgcatgataaaaatcataatgtctmaaattacttactcaataaaatgtgggtttgtctattattagtgattattagggttataatgcagcatggaaatttggagcaaattaactatacatgcaag

SEQ ID NO: 31613 - DNA, 201 bp, Homo sapiens
ctagaataatagactaccaaacacataagcttatttacggtttgcctccttctcatgcttttggaagggaagcactgagggtcattgtatcagtcagcgtwgactaggtttgccgcagtaacaaacgaccccaccatgccatagcttgcaaaaacaaagactgagttcttgtctacactgtagggccgtcaagagctggct

SEQ ID NO: 31614 - DNA, 201 bp, Homo sapiens
aagaaggttttgtattttgacaattccttcatctgttaatttagtcagacgaggaaggaaacgagaaaagttattcctatttcatccatctaagactttayatcccatttcaggctgattaaaaggcaaaatcttcacagtaggacaccaaaccctctgtatgccctgcctgcctccccccctctgacccgcctgcctccc

SEQ ID NO: 31615 - DNA, 201 bp, Homo sapiens
ggtatggtggtgtgtgcctgtagttccagctactcggtagcctgaggcaggagaatggtttgaacttgggaggtggaggttgcagtgagccgagatcatgycactgcactccagcctgggcgacagagtgagaatccgtctcaaaaaataagtaaataaaataactaactaggctaggcacagtgggtcatgcctgccatc

SEQ ID NO: 31616 - DNA, 201 bp, Homo sapiens
ggagtgcagtggcgcattcttggctcactgcaaccttcgcctcccaggttgaagcaattcttctgcctcagcctctcgagtagctgggagtccaggcaccygccaacacgtctggctaatttttgtatttttagtagagatggggtttcaccatcttggccaggctggtcttgaactcctgacctcatgatccacccgttt

SEQ ID NO: 31617 - DNA, 201 bp, Homo sapiens
agagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattg

SEQ ID NO: 31618 - DNA, 201 bp, Homo sapiens
tacctgcaattctttgtacatatgaaatttaatatggtgagattggcatctagctgctgctagagatagtgctcataataatttttaacattgattgagtrtggataataatccaggagctgtgctaaacgttttacaacacattatctcacttaatttcacaactccataaagtagttttcacttagttgagggatgaaa

SEQ ID NO: 31619 - DNA, 201 bp, Homo sapiens
aatctctagggacagaccgaggtttgagagttcctgctcctgatctcaggggaatcctgaattacaggtgttaacctgattagccccagcccagctcttcrttaattacctgaagtgaatgggacagtttccaatactcagcacaaaggcgtgcgcagtgactctgtggcgtactatctatttggccttggaaagttactc

SEQ ID NO: 31620 - DNA, 201 bp, Homo sapiens
taatttttcatttttggtagagacggcgtttcaccgtgttggccaggcttgtctcaacccctgagctcaggtgatccgcctgccttggcctgccaaagtgmtgggattacagacatgagccaccaaacctggtcaattttctatggtgtgtgttacattttttaaaattttattttaatgtttatatagaaaaagttgcct

SEQ ID NO: 31621 - DNA, 201 bp, Homo sapiens
tttgcattttcttgagagaatgtacaggcaagaataaaagtaactagaagagacattgttgttattgagaagtatgaagttaaaattcccaatgtccaggmctgtcttaaaattaggtaaacactgcagaaactatctttgaggaatttaattttgtcttgtggataaaagtgaaggataaagaggagaaataacaattat

SEQ ID NO: 31622 - DNA, 201 bp, Homo sapiens
tcctgcacacttaaccatgattatccctactttgcaaattacaaggttgcagtgcagagagcctaagacactttctcaacttgagcaagtaggagatccasaatttgaacccaaatctctctgaatccaaaacgactttttgttactttgcacacttcagtcataggaatttcagtgtggatttctgtattggttatgtat

SEQ ID NO: 31623 - DNA, 201 bp, Homo sapiens
ttggccagaagctatgaacagttgccacagctgggctgaagagttacctgtgagccttccaggggtgtaagccaagagaaagacagttcaccaaatctatygattaatagaaatcatccagcagcagtgccactgtaagatgttcaatacgtagcacctttctgtcccttctcctctagccagttgggacaggattagcaa

SEQ ID NO: 31624 - DNA, 201 bp, Homo sapiens
tatttctgggctcagcttttgactcagtctcattccccagaaataatccctgttaacatttcggtttgtgttatggaagtgttttctcttctatgaattasctaatgcccataccatacatatgcctgcatttgtacactcttaagccaaataacatcgtactgtgtattattctctagtagcctgctttttattgaactt

SEQ ID NO: 31625 - DNA, 201 bp, Homo sapiens
actcggtaaatttcaacttcatcatatatataataattatttttttttgagacagagccttgctgtgtcatccaggctggagtgcatggcctgatctctaytctctgcaacctccacctcccaggttcaaacaattctcatgcgtcagcctcctgagtagctgtgattacaggtgtgtgctaccacggccggctaattttt

SEQ ID NO: 31626 - DNA, 201 bp, Homo sapiens
gtgaaagaaatcaagacatgcaagcaaggataagtgctgtaaagataattcattcctgtttagagggctgaggacaggaagacgatgctgtatggctctasacagggttctgtgatgagtggcctgtggacagattcctgtccgaagaggtgcagggtgcaagggaggaggggacggcaagtatcaaggtcccgagtgagg

SEQ ID NO: 31627 - DNA, 201 bp, Homo sapiens
gcactcccatcccagcctcacaccaagctcccatctgggaagcagcagacacacataaaagcaaggaaacttcaaggacgctttttgttttcccctacttytaaaaaattgaggtgaaattcacataatataagattaaccatttcaaagtagacagttcaatagcagtacattcacaatggtgtgtaaataccgcatcta

SEQ ID NO: 31628 - DNA, 201 bp, Homo sapiens
cagcttctccatttcttttaaaaagccttgctgggagtttatttgctttggtattgaatctgttgatcaatttgaggaggatcaaaatcctgaaagtgttragcgttaccatccatgagcatgcatctctccatttatttaaggcttctttatttataaacatttcagtgatatttgatgattttgaatgtggaggtctta

SEQ ID NO: 31629 - DNA, 201 bp, Homo sapiens
tgttgagcatcgtctgttacctgaagagcagaaggatgataaaagtgaggaaactgaggcacaggcttgccccaggttacacagctagttatgatggaggstgggtcggaagccaagcgccccccagcccccaccccacaacaggtgtatgtggcctctggtttatccttctttccccctgctcaccacatggcttctcat

SEQ ID NO: 31630 - DNA, 201 bp, Homo sapiens
gcctggccaacatggtaaaaccccacctctactaaaaatacaaaattagtcaggcgtggtagtgtacacccataatcccaggtacacaggaggctgagacwtaagaatcgcttgaacccaggagacgggggttgcagggagctgagatcgtgccactgtactccagcctgggtgacaagagtgaaactccatcttaaaaaa

SEQ ID NO: 31631 - DNA, 201 bp, Homo sapiens
tcatcctgggcaacagagtgagatgctgttttgtttttgtttttttttgtttgtttgtttggttttttttggaaaaagaaagaatcaccataaaaaagatkggtaactcggaaatttcaaatgcttgaatttcttgggttgggaagaatatcccaaaatgtgtttccaactacctcactgattttgacttcacagggagaa

SEQ ID NO: 31632 - DNA, 201 bp, Homo sapiens
ctttcccacctctgccaaggtcaaaaatggaacttgcttcttgttctcgtatcactcagactaagcagttgatgtaacagataacccccaaatttcagtgrtttcacatttaatctgtaaaaaatgaggatttgtttatagccccaaagacagtctagtttggattatttgaggacctagacttcacctgcacagtggttt

SEQ ID NO: 31633 - DNA, 201 bp, Homo sapiens
ttttttttttttgagatagactcttgcctgtcgcccaggctgcagtgcggtggcatgatctcggctcactgcaacttttgcctcctagattcaagcgattstcctgcctcagccttctgagtagctgggattacaggcgcccgccaccacacccagctaatttttgtatttttagtatatacggggtttcaccatgttggc

SEQ ID NO: 31634 - DNA, 201 bp, Homo sapiens
aaagcttttggattctgtgtggaagagttgacagagatttgcaggtgaaaaagaaaagaaaaaaaatacagatacgtgtatatatagagaaagacaaaaayttgtctgctagaaacctagggagagagatggtattgcccctgggacattggactttctgtttccagcatggtctgtcgtcttccataatggcatttaatt

SEQ ID NO: 31635 - DNA, 201 bp, Homo sapiens
aaaggatgattcctgctcacaccagccagctggagacattagagcattacttctcggtggcaagggagggactcttgttctttctggtggttcgttttcaycttcaggtcatgccctgtgtcacctgactcaggcaccattagcatctggggctgtacacgtctttgtactgcacactgtagggtatccaggattcctggc

SEQ ID NO: 31636 - DNA, 201 bp, Homo sapiens
ttattttgatgttgttagctttcaaagattaattccacagagatttttgggcatctttttgataatacacattatgcttgacttgggagtttcaggatgcrcaagagactccttttgactgcaaggactcagtaaaacaaagtatttcaaggtcatgctacaaaaagtcccaccaagagcatggtcaggaggtacagtgca

SEQ ID NO: 31637 - DNA, 201 bp, Homo sapiens
gactaattactaaatttttaaaaatttttttagacactgagtctcaccgtcttgccctggctggtctcaaactcctgggctcatacaattcccctgcctcmgaatcccaaagtgctgggattataggcatgaggcaatgtgcccggcccacaatggttttcatatagctattgtgtattgcgttattgccttagtcacaga

SEQ ID NO: 31638 - DNA, 201 bp, Homo sapiens
caagaatttatcccttctgttgatgcaattaaagctaatggatctcatatatatatatatatatatatatatatatatatatatatatatatatatatatwtatataaatatattttatatttaaaaatatttatattttatatatttttatatatttatgcaagtatatatctaaatatataaaatatatataaatatat

SEQ ID NO: 31639 - DNA, 201 bp, Homo sapiens
cttggcagcctactctcctctctcgaagctccatgcccaccttgctgttgcaccccccaccccaaggaaagccttcccacctttggaagctgcattaattmttccaggccacaagggggccgttgagttactggttcactgcactggctggcaggaaagagttttaatgcaggctccaaaggtgcttaatttcctgtggtc

SEQ ID NO: 31640 - DNA, 201 bp, Homo sapiens
tttaggaattccattcacagtaaattttatgcgtggtgaaaggttatggaatgggtttccatgccatgtctccccctgtcccacaaatctcagctggcctkcaaaggttccactgtggatttttgccagccagccacgctgatgtagacagaatatttcggatttatattattgcttacttggcacatcttccattggaaa

SEQ ID NO: 31641 - DNA, 201 bp, Homo sapiens
cattcagttcacggacatgtgggttgtttccacattttggctattgtgcataatgcttccaggtacacttgtctacacatttttgtgtggatataggtttwccttttttggggtatgctcctaagagtgcaatttctggatcacggggaactccttgtttaaccttttgaggagccaccagattgttctccacagcagcca

SEQ ID NO: 31642 - DNA, 201 bp, Homo sapiens
taatgattttgaacatgaaaactatgcttattgctcatatctatgttattttattatttactttttttgagatggagtctcgttctgttgcccagtctggrgagcagtggtgtgatcttggtttactgcaacctctgcctactgggttcaagcgattttcctgcctcagtctcttgagtagctggtgttacagaagcctgc

SEQ ID NO: 31643 - DNA, 201 bp, Homo sapiens
ggtcctccatgtacagccatgatcacaactctctaacgtggtcacttgcttgcacacacttgtttagatgtctctgccctgctgttaattagactgtgagyctccagagggtgagactgacatctcatttctctttgcagtcacagcagagatgcaggcccacagtagggactcaccagatgtggcagggtgagggaattg

SEQ ID NO: 31644 - DNA, 201 bp, Homo sapiens
ccaaaagcggattattgacctctgtgcccatcttgggagaaattgccacttggtctgtgtctacacagacccaagaggagaagggatttgacaatggtctsattaattgaatcagtggtttgggggagtgggctgtctgtattgatccaattaaatagataattgtcagaatcgaggtcatgtctataagacaccaccatt

SEQ ID NO: 31645 - DNA, 201 bp, Homo sapiens
ataggaacatgaatttgcattccttccaactggtgtgtttccaaaatacagacaggcaagtttgaatcactttgactttgaaagcgtgattttgagcaatyatctggggaaaaaaatacctcctcttcactaaataagtctgtcaaaaagagtcatagtacagcgtgccattgccagaatacacgtgtgtgctggtaagct

SEQ ID NO: 31646 - DNA, 201 bp, Homo sapiens
cctggctaacatggtgaaaccccatctctactaaaaatacaaaaaattagctgggtgtgttggtgggcacctgtacttccaggtgcttgggaagctgaggmaggagaatcacttgaactcagaaggccaaggttgtagtaagctgagattgcaccactgcactgcagccttggcaacagagcgagactccatctcaaatca

SEQ ID NO: 31647 - DNA, 201 bp, Homo sapiens
ccatgtttctttatcttcttctttttttttttttttttagccatagtctcactctgtcacctaggctggagtgcagtggtgcgatctcggctcactgcaarttctgcctgctaagatcaactgattctcctgcctcagccttccaagtagctgggattataggcatgagccaccatgcctggctaatttttgtatttttag

SEQ ID NO: 31648 - DNA, 201 bp, Homo sapiens
taatggcccatcatttataatggctgcctgataattggagatacatgcaccagacttgacttaactgttctcttagtcatcagacatttagatttcaacakgctcctgttaagctctccttacagtgtgtgtggcactgtgcagttgaatgaaacatgccatggccagtggaaacaggcttgggctgatggagagggccta

SEQ ID NO: 31649 - DNA, 201 bp, Homo sapiens; identical to SEQ ID NO: 8644

SEQ ID NO: 31650 - DNA, 201 bp, Homo sapiens
acctattgctcatttttaccagttaaaactatttaatgagcatttgcccactttctaaaaatatgatggtcttagttacccacatggacctactctatccyaggcagatgccacaaattattttgttttctttttgtatatatttatgctgtttcctcatttttaaatagtgggctttgatgactattcttctacataaat

SEQ ID NO: 31651 - DNA, 201 bp, Homo sapiens
ttttaaataaaaatgcaaataagctactttgtaaccacattaattacccacctagcctcttattaccatgtttgtattgtttgcaaatactatttacagtygtgtggaaattaacattactggtcctgaggaaagattgtgttggggaggttgtgctttggaaccaattagggcgaaccttgtctccactgagactctggg

SEQ ID NO: 31652 - DNA, 201 bp, Homo sapiens
ttgggctgaattagcgaggggagtgcggggtctggagactctgttggcctgttggccatggtcctgggcgcaaagagcagaaaaggacgagacggggactraacagacttgcttagttcctgacattcaaggaagaactttaacgtccatccacggagcctcaaaggctaaaaataatcatccctttcaatagttcctgtt

SEQ ID NO: 31653 - DNA, 201 bp, Homo sapiens
atttatttatttatttatttatttatttgtttgtttgtttgtttgagatgagtcttgctcttttgcccaagctggagtgcagtggcatgatctcggctcaytgcagcctctgcctcccgtgtccaagtgattcttctacctcagcctcccgagtagctgggattacagttgtgcaccaccaggctctgctaatttttatat

SEQ ID NO: 31654 - DNA, 201 bp, Homo sapiens
gactgtctccaaaaaaaaaaaaaaaaaaaaaaagggcatggatctagatgccagacaatctgggtgcatatctttgctccaaaagcaaagattgtaaactstctttacaatctggggcaagttagctaatctctgcttcagtttgctccttagcaagatgggatgatattaccacttacctcagagagttgttaaatgggt

SEQ ID NO: 31655 - DNA, 201 bp, Homo sapiens
attttctgagctggtgatgagctgcagggggcctctcccagcccccgcactggttgcacttttaaataagagaaaaaaacagtgataggactgacctgcgygtagaagtttcaagttacaagaaaaacacttcacaggatccaaatccttaaagtcctgaaggaaacagagagcatatacaccagctttcgccacccaatt

SEQ ID NO: 31656 - DNA, 201 bp, Homo sapiens; identical to SEQ ID NO: 8645

SEQ ID NO: 31657 - DNA, 201 bp, Homo sapiens; identical to SEQ ID NO: 8646

SEQ ID NO: 31658 - DNA, 201 bp, Homo sapiens
tattggccagtatattcaatgattcacttgcacctttaaccttgtgttgttctaatctttttttttttttttttttttttttttttttttttgagacagartcttgctctgttgtctaggctggagtgcagtggcaccatctcggctcaccacgagctctgcgtcgtgggttcatgccattctcctgcctcagcctccgga

SEQ ID NO: 31659 - DNA, 201 bp, Homo sapiens
gaatacactgttacccctcaatcaacactacaattcatatatcagaatagcactttgttacttgtttctgagatagggctggctctgtcacccagactggwgtgcagtggcacgatcacagctcactatggcctcagccaccagggttcaagtgatccttccactcagcctcctgagtagttgggactacatgcctgcacc

SEQ ID NO: 31660 - DNA, 201 bp, Homo sapiens
atatagatttgcctattctagacttttcatataaataaatcagatactgtgtggccctttgtgtctcgatccttacacttagcatcatgttttcaagggtyattcatgttgtagcatgtatcagtacttctttttttagggctgagtaatattccatttacggatatgccacatttcatctatgcattcagttcacggaca

SEQ ID NO: 31661 - DNA, 201 bp, Homo sapiens
ttaacaggtttatttcttcatcagatattaattccagagggtttcacccattataaaatggacataaagcctggggtggtgatggtgctgcctctgtaacyaggctcagctgtgtgtcttcgtgagcctccttgtggaccctcaaatgtgggaaggagataggggcaggaggaattggggaaataggaaccttagaaaccc

SEQ ID NO: 31662 - DNA, 201 bp, Homo sapiens
tctgttaaacataagctttcaaggtgagttgtgcagaggcaagtctgcttgtttcatcaagctgacgtttatacttctgagtaagtagggggatccggagmgtcttcttgtcactcaaacagtttccgtacgtcagtttcacacctctgttctgcatgtctctgttgggaaggatgctgatgtctgggatttgaaatagag

SEQ ID NO: 31663 - DNA, 201 bp, Homo sapiens
gaatggtgggtggtaggtgggtacatagatggatgtatggatgggtgggttggtgggtgcatggatgggtgagtaaggggggataaatgaaaggcttgttyttctgaagggactctttacaaagagtctttgatcttccagcttcacgtgcaagagaatccccaaggtgagcttgttaaaataagcatattctgggtatca

SEQ ID NO: 31664 - DNA, 201 bp, Homo sapiens
tcctctctctcaaggaaataagatattcatttgcaagtaaataatgcagcagtcttggatttgtatcagatcaactttgaatgaaagcctgcctttctgcstttatttttgcttatctctcctgcttctgcttcctgttttgttaaataagggcaatgacggcaactattttaaattgctataaagttttagctagacagc

SEQ ID NO: 31665 - DNA, 201 bp, Homo sapiens
tggctaatcatttccattttatagattaggaaaccaaggtccaaagtggtgaattgatttgaccaaaatcacagacccaggaatttcctcagccaagagcmtacagcagctgtgtcttaagactgtgccctttcatccaccctcttggtactcaaagcttggtccatgaaccagcagcttcagcatctgctgagagcttgc

SEQ ID NO: 31666 - DNA, 201 bp, Homo sapiens; identical to SEQ ID NO: 8647

SEQ ID NO: 31667 - DNA, 201 bp, Homo sapiens
ggctgaggtgggctggatcacttgaggccgggagtttgaaaccagcctagctaacacggtgaaacccttctctactaaaaatacaaaaatattatctgggygtggtggagctttcctgtagtcccagctactctagaggctgaagcatgagaatcacttgaacccaggaggtggaggttgccatgagcagagatcgtgcca

SEQ ID NO: 31668 - DNA, 201 bp, Homo sapiens
accattgcttcaaatcccgacctctccagttctcctggtttcttgttaggcgggaacttgggcttctttatcagtgactggggtcagttcttgtactcaayttcctatctctgtgatctcttgtaagatgctgcattgtcaaatggagaaaacattgtctttgagttgttaggagccttgagtgagatggtatgcaaatgt

SEQ ID NO: 31669 - DNA, 201 bp, Homo sapiens
cacacacacacttttaagcatttttgatttatatatccctctgcatattttgtgccttgtgatgtgtttaacgaatgacagtgtctttagtgcattgctayttggggtttctacactggaagtgtaatccgaggccttggaattggtcaaacaaaactcacttggcaacatttacttagagagcactctgcgagcactctg

SEQ ID NO: 31670 - DNA, 201 bp, Homo sapiens
ctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcac

SEQ ID NO: 31671 - DNA, 201 bp, Homo sapiens
acaagatgtttaaatcactagtaaaatttggccagacacggtggctcatgcctataatcctagcacgttgggaggctgaggtgggtggagcacctgaggtkaggagttcgagaccagcctggtcaacatggtgaaaccccatctgtactgtaaatacaaaaaattagctgggcatggtggcaggcacttgtaatcccagct

SEQ ID NO: 31672 - DNA, 201 bp, Homo sapiens; identical to SEQ ID NO: 8648

SEQ ID NO: 31673 - DNA, 201 bp, Homo sapiens; identical to SEQ ID NO: 8649

SEQ ID NO: 31674 - DNA, 201 bp, Homo sapiens; identical to SEQ ID NO: 8650

SEQ ID NO: 31675 - DNA, 201 bp, Homo sapiens
cacctgacctcaggtgatctgcctgcctcagcctcccaaagtgctgggattacaggggtgacccaccacacccagccagagtcaagtatttcaagtattaragttgtctgcctgcctccctgtctccctgccttccttccatctgtttgttatctgacttaatctttgaaataacccaatgatacatgatatgcattttct

SEQ ID NO: 31676 - DNA, 201 bp, Homo sapiens
tctgtgcacaggcagtattagaggagtggcttaccaaatagatcttgatcgcagacacggaaaaaaggattattcctccccttttatcaagagccgtaagwccttggaaaatgcaaagagggggaaaaagaagaaaaacagcaacgagtttattggagagttaacacttaaatactccagtacattgagtgtgacatgcct

SEQ ID NO: 31677 - DNA, 201 bp, Homo sapiens
cccttcccatgatttttctgcagaatttatgcatccatgatactgcagaagttcataaataatggcttgtattgctgctttagtattgctttatgcctacraaatataatgttaatttgtagcaatgctaatgtgttttcaggaaggctctttgtttattgcctttattttccccacttaccaagtgggtaaaatgctttg

SEQ ID NO: 31678 - DNA, 201 bp, Homo sapiens
tgtaatcccagccacttttgaggctgaggcaggagaatcactggaactgggaggcggaggttgcagtgagctgagatcgtgccattgcactctggcctggrcaacgagcaaaactccacctcaaaaaaaaaaaaagagagagagagaataaggtcagagggggaaaagagagaaagtgaaagcaacagtaaggaagagaat

SEQ ID NO: 31679 - DNA, 201 bp, Homo sapiens
accagcagtaaaaggtagccctgccaagaccattaagcttcctgcaactccttctggatcccacaatttgaaggggaaatctttcccaccgcacatcactrtttggtggactaaatggctccccgatgtcccgaaagagcacagcttctggaagtgtggtatgtggtccctgagatgaagcagcagccacaggaacccatc

SEQ ID NO: 31680 - DNA, 201 bp, Homo sapiens
atcatgggggtgggtctttcccatgctgttgttatgatagtgaataagtcccatgagatctgatggttttataaagggcagttcccctgcacaaactctcytgcctgctgccatttaagacatgtgtttgctccacattggccttctgccgtgattgtgagactttcccagccatgtggaactgtgagtccgttaaacctc

SEQ ID NO: 31681 - DNA, 201 bp, Homo sapiens
aatgtcttacatttatagagtgttcaaaaggtgccagatattgtgctaagtgctttgcgggcattatgttattcacacttcacagatattctctttctacmtgtaaggaaaaaaaggcataaatactttatataatttactcaggattttaagtagagggtagattttaagtccaggcagtccaaccccctgaaagctgac

SEQ ID NO: 31682 - DNA, 201 bp, Homo sapiens
tgtgtcaattaataatctgactaaggtggccgggtgtggtggctcacacctgtaatcccagcactttgggaggccaaggcgggcggattgcctgagctcaraagctggcgaccagcctgggcaatacggtgaaaccccgtctctactgaaaatacaaaaattagctgggtgtggcggcatgcgcctttagtcccagctact

SEQ ID NO: 31683 - DNA, 201 bp, Homo sapiens
gctactagggccacatcttcccctttcttctcccccaggtttgtcccatttgtactgactctgacccaggttgtcatgacttgagactcactagaagtttsagaaagatgcagactgctttaaaaaaaaaaaaaaagggcaaggggaggtgtgagaagaaagtataattctttttcttctaactggagatataaaaatcat

SEQ ID NO: 31684 - DNA, 201 bp, Homo sapiens
atcaggtcacttggcaaccaagctgatgaggatagcagtttcttttgttcttttaaaacatatataaaattatttttatcaaacatgacagatcaaaagcyttctggaaaggagagatggtaactaatttaggcagtgtcttttgctttcacatggtgtacccagtactattaatatgaatttatcacatggaaacaaact

SEQ ID NO: 31685 - DNA, 201 bp, Homo sapiens
gggcattatcattccctttataggggacacagctgtggctcagaggggtttattcactttcctgagggccacacacataatgagaggcagacacaggtgasgaagtgagttttccctgtcacgccatcttatctgtcacatacctctctgacatgctaaaattgcactaaacaaaagaattctcttatgcacatatcatgc

SEQ ID NO: 31686 - DNA, 201 bp, Homo sapiens
cagaggggtggtctgcccctgtgcaggcaggaatgttcaggaagcaggctgcctctgtttctactctaaatatttaacattcacggatggcatggatcctsactaagcggagcagatgctggctctatattgcacatagctcctgaatatcagccctgcttggctatgcatgtgttttttgttagtttttgagacagagtc

SEQ ID NO: 31687 - DNA, 201 bp, Homo sapiens
tttcaactcctgacctcaggtgatctgcctgcctcggcctcccaaagtgctgggattacaggtgtgagccacagcgcccggtggtcatatctctttcttgsgtttttgtgggggttggggtaataggtttattgagatataattcatataccacacagtttcatttttagtgtattgacaggtgtgcagtcatcgtcacaa

SEQ ID NO: 31688 - DNA, 201 bp, Homo sapiens
ggaggttgtggtgagccaagatcgcaccattgcactccagcctgggcaacaagagcgaaactctgtctcaaaaaaaaaaaaaaaaattatgtccttctagmttgtgaggattaagcaagaccatgcatttacattgtttaacactgtccctgagacatagtaaggcctcagtaactgttagctctcttattgctaccggac

SEQ ID NO: 31689 - DNA, 201 bp, Homo sapiens
aggatgctgtgctaatgtcttccttttttaattgagtaaatatattatacacagctgggtaggttgtttccttgctggccttactgctacaatttgaaaayggatacagttttctttaactcacataggatgaatgtggcatttattcctggtttcctgtggctctcctcctttagaaaacgtatttacatggacgttttt

SEQ ID NO: 31690 - DNA, 201 bp, Homo sapiens
tgatggaaaaacaagcacagagaggctaaggaatatgctgaagcttgcacagctagtaaatggcagaacattcagactggaattcagacttatacactcayattcataccacacagcctctcgaagggacgtgccccttgaacgcaagagaggtacattgggtggccatggtgctcacagtctctcaatcctttatgttga

SEQ ID NO: 31691 - DNA, 201 bp, Homo sapiens
ctgcactcccgcccgggtgacagagcgagactccgcctcagaaaaaaaaaaaaaaaaaaaaaaaggaaccagatggccctgcccttgagcaggctgtggtstggcctggtggagagacagagaatcagttaattccagggtcatgtattaggtagtaagatagtggttcacaccaaaaacatagaaaatgatcacttagcc

SEQ ID NO: 31692 - DNA, 201 bp, Homo sapiens
taaattgaattattcccgctgccattcagttttactctgcacaaaatacagccaacatttttgcatttctttcttccttcctccttttcttctttctttcyttccttccttcctttctcccttcatctatctttgttccgcttttgtttgtttttttttagatcgctgcatgctgccgcgttgggttaaccatggtagcat

SEQ ID NO: 31693 - DNA, 201 bp, Homo sapiens
gagactgtaaaagtggactatctgcccaggagacagtgaggaaggaaatcaggggtcacccttacagggaagggctctttgcagagagagtgcctgatacrtagcagctggtacttctccatcttgaaactgtccttcctggttttgtctaatttgtcatcatgggattcttttgacttgtttctagattagggatcaaga

SEQ ID NO: 31694 - DNA, 201 bp, Homo sapiens
actgtctaagcatttttaatagttttgctttccatggcacgcaactcatatactaaattaaataagctgttatctggtgcaatttctccttgaatagactyagaattacctatagatattgacacggttattttataaattgagttccagcaacacaaggcaaaaattttggcctgtatgtaatgaaggaagagttgtcat

SEQ ID NO: 31695 - DNA, 201 bp, Homo sapiens
gtttccaaggcttgtctaagttgtggcatgtgtcagtactttattcttttttatggctgcatagtattccactgcatggatataccacatcttgtttatcygttcatccattgatggacatttgggttgtttccgccttctaggtataatgacttgtgttgccataaacatttgtatacaagtttctgtgtggacatgttc

SEQ ID NO: 31696 - DNA, 201 bp, Homo sapiens
aaaaacccttgtatccttgttttgtttcgtttccctgcaaacattgttttagttgagatgaaattcacgtaatatacagttaaccattttaaagtgtacasttcagtggcatttagtgaactcagtgttatgccaccgtcacctctttttagtttcaaaactttgtcatcaccccagaaaagcatacacataaagtcatca

SEQ ID NO: 31697 - DNA, 201 bp, Homo sapiens
tttaatactgctttttattttatagaaaaatataaatcaatactttcatgtctgtttgacgtgtttgggagctacagcaattgaggcttgccagtgtctgratgccccaccactaccacgccacttagctcagagtttgtttttttccttccaccatgtgaaatgttgctggttaaccagttaaaacggggagatggccat

SEQ ID NO: 31698 - DNA, 201 bp, Homo sapiens
cccacaagagagaagtagacagagacctctggaagtttaaaaatatatatgttgggatttcatagatgaggtgagcaaaaaattggccgggaagaactatkaaggaggagatgatcagaaacattttcaaaatacctggaacaaacaaagaaccacatttcaagaaaaagacagagaaacaagactagcaaatagagtttt

SEQ ID NO: 31699 - DNA, 201 bp, Homo sapiens
ctcttttaaaaagttctaagttgctagccagtcggaacaaatacagaatgtgaggtccctttccagccaatggaaaccggacacagcagtagagtacacgygtcaggttataaatgagcctgtctcctttgtccggtgttctctcatggcaaaactgctggcgagtgtaccctttctgcagaaagtaaaaatggccttgct

SEQ ID NO: 31700 - DNA, 201 bp, Homo sapiens
acctttggtgtttggggcatgttgtcacctcattgccatctctgcctctgtcttctcaccaccatcttccttgtccatgtctctctatgtcttcaatgttsttcttataaggacaccagtccttggatttagagcccaccctaattcactgtaatcacatcttacctaagtccatctgcaaagaccctatttccaaataag

SEQ ID NO: 31701 - DNA, 201 bp, Homo sapiens
aattgaagaggctattccaaggtcacatgacttttaagtggcagaaacaggggaattctgtctaacacaatccaatttatccatctcaagaaaagagataygccaaagagaatgattattaaattatcattaatgtgaactcttgtaattactctcataattttctttaggcttatcccattgggcattgctaagtattat

SEQ ID NO: 31702 - DNA, 201 bp, Homo sapiens
tcctgtcaattgggaaaatatcgtgaggcggagatgtgagatgtgatcacgtttataaagtctgcggcaagaggatgataaagtcacttctcaactccttstcaactcctcctcctggcttattaatgcccatcctttaacctgtcctctgctttatctcttggaatccttagggcctttttaaccccatatacgaagcaa

SEQ ID NO: 31703 - DNA, 201 bp, Homo sapiens
catggcctgctcacaaatcttatgataaaactctacccactgagaagcacaaggtgtgaggctattgatgaggagttgaaggtgacagagactgagaaagkgctgcacacctttggcctaaagggtaatgagcaacacacaaggattgggagatgttcatggcaagaaaaattcagaagggacattgttgtttcactaatt

SEQ ID NO: 31704 - DNA, 201 bp, Homo sapiens
tttcatgcttcttaaactggggtatgagtggccccaggtttccctgttgggggtactgataccagagttcatttgaagtcattggaaaccaaggcatattytcttaaagagacaactgtttttggtgaataggccatgttgtttatagtaaaaacaaacatgaatattctgtaatagaagatatcgtttgcatggtgtttt

SEQ ID NO: 31705 - DNA, 201 bp, Homo sapiens
agcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcattta

SEQ ID NO: 31706 - DNA, 201 bp, Homo sapiens
gacaaccttttctgcccttaatcacctctcacagatgagaatccacccaagaagaagaaaaaaaatcagccccttaaaatgctgactagtaacatcagttyttggaaggatactatttttgtttccattctgtctttatagtttgaacttttccttttcatagtctgtaaatattcatcatctcagagccttttgaattgc

SEQ ID NO: 31707 - DNA, 201 bp, Homo sapiens
catggaatattgtcagacagagaaactcacctgagcctctgtgttcagagtatttattgggtcttcgttgcgtaggtgtgattgggtgattgcccacatakttgatctcagcctccaagtcaactgataactgtggtacagtgtccctaccctaagcaatattgttggtcctttaagaatggttcatctgcaacctaaggt

SEQ ID NO: 31708 - DNA, 201 bp, Homo sapiens
aaaaaaaaaaaggaaccagatggccctgcccttgagcaggctgtggtctggcctggtggagagacagagaatcagttaattccagggtcatgtattaggtrgtaagatagtggttcacaccaaaaacatagaaaatgatcacttagcctgatccagaagttcaggaaagggctctgagcaggagatggaagacctcttggc

SEQ ID NO: 31709 - DNA, 201 bp, Homo sapiens
atgagtctaccatccagattcagtaattattacatgtggccattgttgttttatctctctccacccacttcccccatgcctgaaaatttaccaaagtaaaygcaagacattatatattgttattcatagacattttgagtaactaaaagtaaggtctctttaaaaaatgataattacagtatcatcatcacacccaaaaac

SEQ ID NO: 31710 - DNA, 201 bp, Homo sapiens
ctgctgatgcatgtgaaattggctttgtgttggggcctcttcttccaaagcaacagtaagcattttttttttttttgtgataatctctctctgtcacccaygctggagtgcagtggtgtgatctcagctcactgcaacctccgtcttctgggttcaagtgattctcctgcctgagcctcccgagtaactgggattacaggc

SEQ ID NO: 31711 - DNA, 201 bp, Homo sapiens
gggattataggcgtgagccactgcacctggccagtagtagacttttgatagggtttttttttctcaaggtgtaggtttggctaggaagtcatagaaaatgstctttttttttttttggagatggagtctcactttgtcacctaggctggagtgcagtggtgtgatctcagctcactgcaacctccatctcctgggttcaag

SEQ ID NO: 31712 - DNA, 201 bp, Homo sapiens
ctgggctacataaaattatatatatatatatatatatatatatatatatatataaaataatgcagaagttttatatatatataaagttttatatttatatmtataaagttatatatatatatatatatatatttatttattttcaagacatggtggcatgcaactgcagtgtcagctactccggaggccgaggcaggagag

SEQ ID NO: 31713 - DNA, 201 bp, Homo sapiens
tgtgagtttgactgctttaaattccacacaaaaagtgagatcatagagtatttgtctttctgcgcctggcttattttacgataaattgattgcttctcttyccattgtttatagatacccattctcgtaatgatggcactgtgtctgtcatagaaggcctaattctccctgttaacattgaacataaaaacctcatatggg

SEQ ID NO: 31714 - DNA, 201 bp, Homo sapiens
gcaacccgggctgtgttcccgagtgcatcaaacggggattgggacctgttttccttcccactcacatgtaggtcacctacgggagcaggggaggaaccatytgaggtgtttttttttttttttttagatttctcattgctgagaacagttccagctctgctgaccaaaggctgagtgtccttttattagtctgagccccta

SEQ ID NO: 31715 - DNA, 201 bp, Homo sapiens
ctgttcttgtactcctgggctcaactgatcttcccagcttggcctcccaaagtgctgggaatacaggtgtgagccactgtcccaggccagttttaactcasaatgatttcataagaaatccacatctgagagtcccagaaggtaagatattcccctttcttctaaatatacttgaccaccaccattcaggttcttctatta

SEQ ID NO: 31716 - DNA, 201 bp, Homo sapiens
atcgagaggtaaagcactgtgcagaaatattggccagaagctatgaacagttgccacagctgggctgaagagttacctgtgagccttccaggggtgtaagycaagagaaagacagttcaccaaatctatcgattaatagaaatcatccagcagcagtgccactgtaagatgttcaatacgtagcacctttctgtcccttct

SEQ ID NO: 31717 - DNA, 201 bp, Homo sapiens
tttctcatgcttccatttccatattctcaatcaatcactgatggccagctgtcaacaggcatcatttttggtgggacctgaagatgtatatcccttgtttkcagattcctcgcctctcatcatgtaaggtgatgctctgagctgggtcttaaagcttctgggcacagccccccttgagtcttcattatggcaaatctagtg

SEQ ID NO: 31718 - DNA, 201 bp, Homo sapiens
ggatgacaagtggatacttaagaaaaagtgtattttggagaaagttgcaataatacctactagagattgtgtcctccctcaaaatcggagtgccatccgcsctccatgagtctgacactttgtaggtgctttataaatatggattgaagcaaatgagtgacgttcatatgatgttttgcagttttttcaaagtgggtttta

SEQ ID NO: 31719 - DNA, 201 bp, Homo sapiens
aaaaaaaaaaaaaaaaaaaaaaaaaaaagaaagaaagaaattacaggtaggctagagcacggatgagcaaactgtttttataaaggaccagagagtatatrtttcaggctttgcaggccctatgacgtctgtcacaattcacttctgcctttctactgcaaaaacagccatggacaattcataaattaatgtgcatggccg

SEQ ID NO: 31720 - DNA, 201 bp, Homo sapiens; identical to SEQ ID NO: 4888

SEQ ID NO: 31721 - DNA, 201 bp, Homo sapiens; identical to SEQ ID NO: 8651

SEQ ID NO: 31722 - DNA, 201 bp, Homo sapiens; identical to SEQ ID NO: 8652

SEQ ID NO: 31723 - DNA, 201 bp, Homo sapiens
ctcctgagctcaagcgatcctactcactcggcctcccaaagtgctgggattacaggtgtgagccaccatgccaaagcctaagggaccttagaattttttcycctttcttttcacattttgttttgtgcttgcttatttattgaaatctggaccacaaataacttacatgtttgtcaaggccagatttcaggacctaaccaa

SEQ ID NO: 31724 - DNA, 201 bp, Homo sapiens
gtaggtttttcaataagaaggaaatttagcttccttctactttggtgccccatgatgatgtgcatcttttttatttctgcatcatatccatatagtgatawcatgtataatgatgtttaagaagacagttttttttgtttaaattgttataaataagtaagtgtatgcaccactatgccatgtagcatatcaagattattt

SEQ ID NO: 31725 - DNA, 201 bp, Homo sapiens
tgtaaatggatactaatgtgaacgaagccaccgtgaatattgatgcactagtctttgtgtggacatatatctgttttatcttgggggataatactctggartggaatgggcagggtggtccgtatagggctatgtataactttttaagaggttggcaaatacttccctaaagtggtcatcccattttacattcttgccaac

SEQ ID NO: 31726 - DNA, 201 bp, Homo sapiens
aggcatgctactttatatggcaaaagggaatttgcagaagctaagcactttaaaattattatctccttaaacctcactgcagagttataaggaaagcactrttatcagatgaagaagtagatttcatcaagtgactcacccggtatcatatagctgcttagcggcaaaaccaggatgtgaatggagagctctttctcggat

SEQ ID NO: 31727 - DNA, 201 bp, Homo sapiens
gcagccacaggaacccatcattcctgctacccaaggcctccattgcctggttttctgttgtcagaagagttcattttcaggtccttcaccagatattttaraagctcatcaaggaaaggacgtttgaagaaaaacaaataaacaaaaacacaaaatcaaggacgtattgatttctgagaattcctcctgggttttgtttgt

SEQ ID NO: 31728 - DNA, 201 bp, Homo sapiens
acccactgcaagtttgaggtggtcctcaaacccatcctcatggctgatatttgctagaaggacttgtggcacttagcagaagctattgtatttacagttamagtttattacagggaaaggatacaggttaaaattagatcggggaagagacaaatggggcaaagtccaagacaagtaccagatgtgaagcttctattgtcc

SEQ ID NO: 31729 - DNA, 201 bp, Homo sapiens
taagatgccacaggactatagcctgggcagttttgagtgctgcctctaccatgtaactagcttgccagtcaagtcattaactattcggggccttagtttcstcttttctgaattggagccagtatacgtaattccaaaggttgcttttaagcgtaagtgagaatattggcagaaattcgttagcactgagagagggaatgt

SEQ ID NO: 31730 - DNA, 201 bp, Homo sapiens
gcacctctcaggttcaagcaattatcaggcctcaacgtcctgagaagctgggactacaggcatgtaccaccacactcagctaatatttgtatttttagtaraggcggggttttgccatgttgtccaggctggtcttgaacacctgacctcaggtgatctgcctgcctcagcctcccaaagtgctgggattacaggggtgac

SEQ ID NO: 31731 - DNA, 201 bp, Homo sapiens
tgagaatcacaggcgtttttgaggctcatggctataatcccagcacttggggaggccgaggcaggtggatcacctgaagtcaggacatcaagaccagcctrgccagtgtggcaaaaccccacctctactaaaaatacaaaaaaaaattagctgaacctggtggttcacgcctgtaattgcagctactcaggaggctgaggc

SEQ ID NO: 31732 - DNA, 201 bp, Homo sapiens
ctttgtttcatgtcagatccgtatcccactgcaattctgtgttactgtaggagatttggggttggcatgccagagtgaaaacgcgaaagaaaataaacagrcagcactgaggaattatacacttgagcttggcatttttcttaacgcagggctattttaggtgcactgcgcatgttggaggtgcccttgcaggtataggta

SEQ ID NO: 31733 - DNA, 201 bp, Homo sapiens
tgcgggtggatcacctgatgataggagttcaagaccagcctcaccaacatggtgaaaccctatccctattaaaaatacaaaaattaacaggcgtggtggcrggcatctgttgttccaggtactcgggaggctgaggcagcagaattgcctgaactcgggaggtggaggtagcagtgagctgagatggcaccactgcactcc

SEQ ID NO: 31734 - DNA, 201 bp, Homo sapiens
ctgacttctgtgcctgttttcttgcctaagcggtggacgcattgagtaggagaaggccagttattcctctttgtcactgatacaactggggacctgttgcyggagatgtggagctgtgcattagggctgggtagaacacacataatgaaccatatgcacgagaactttttcatctttctgcatacacttggaactagttct

SEQ ID NO: 31735 - DNA, 201 bp, Homo sapiens; identical to SEQ ID NO: 4860

SEQ ID NO: 31736 - DNA, 201 bp, Homo sapiens
cagccgggggtgacagagtgagaccctatctcaaataaaaataaaaatagaatacaaggggggataaagatagacttaaaatacgctctctagaaaaaagwaagaaatatggaaagaaatctaatttagaaaaatgcacgcacccacaggcacgcttcacaggactggcaggtggagaggatgtttgttaacagggctggc

SEQ ID NO: 31737 - DNA, 201 bp, Homo sapiens
gaatacattttatttatttatataaatacattatatttattcacataaacacattttatttatataaataaatccatttttatttatttatataagtaaakaaattttcctataaataatctttctgattgacagatagcgaccttcctgctatgtccttacatgacagaggaagagatcatctttcttcagcctcttctg

SEQ ID NO: 31738 - DNA, 201 bp, Homo sapiens
tataatcaatatttagtgatttgacttcttaagtccttaaaaaaaaaaaaatccaggtgcaaaacacaaagacagggctcatgtcaagggagggaacctcrctcttctactctcagtgaaagaaaggcaagaccactccagcctattttttttttctttcccttggcccttgtcaaaagggtagccagttttctgttacca

SEQ ID NO: 31739 - DNA, 201 bp, Homo sapiens
gttactgctgtaagccactttcttctccctctccgttaaaatgcaacttaattggtaaagtttagttgactagagatttcatttatttatttatttatttrtttatttatttatttgtttgtttgtttgtttgagatgagtcttgctcttttgcccaagctggagtgcagtggcatgatctcggctcactgcagcctctgc

SEQ ID NO: 31740 - DNA, 201 bp, Homo sapiens
tcttacttaagcatcacagtctagactagaattcccaagtcaaccgtttgttttacgggactcttcttatttgaataggcaggtggccctgtgttcttggsttttttgtcctttcaaggagctaggtctaagaagtgatagtatttaatctcgcactccgaagcgcacccagatttaaaagttgggagtggcccatacaca

SEQ ID NO: 31741 - DNA, 201 bp, Homo sapiens; identical to SEQ ID NO: 8653

SEQ ID NO: 31742 - DNA, 201 bp, Homo sapiens; identical to SEQ ID NO: 8654

SEQ ID NO: 31743 - DNA, 201 bp, Homo sapiens
gtttccttttctgaagattgcctgtcctagacaccagttctctgttctctgtgactctgattcctgtctcctcttctttcactctcatccattttcaatastggcccctcatttcacttcctcagctaaatctacctctcaaagatagacatggacatataaataattttttaaaatcctcttttgcaaaaaaaaaaaaaa

SEQ ID NO: 31744 - DNA, 201 bp, Homo sapiens
ttttggcagccttacttggtagacactatgattcccattacatacatggaatgtacagtaactgaggatcactgtgatattgggaaagtgggacttcagaygctagcctccccttgtagtgcctgcattcttttcacagcccctccccaccttagaatcattttcttcaagggagagtatggtttgtgatgcccttatcag

SEQ ID NO: 31745 - DNA, 201 bp, Homo sapiens
gaagtgatgcaatctcaggtcactgcaactgctgtctcatgggatcaagtgatcttcacacctcagcctcccaagtaactgggaccacaatgcccagctamtttttatatttttttgtagagacggtgttttgccatgttgcactggctggtctggaactcctgggctcaggagatctgcctgcctcagcctcccagagtg

SEQ ID NO: 31746 - DNA, 201 bp, Homo sapiens; identical to SEQ ID NO: 8655

SEQ ID NO: 31747 - DNA, 201 bp, Homo sapiens
gcaattttttgtttttttcattgcctggtgggtttttttttttttgtctttttaaatgctccatgtagaaaagaattcctggaatagttcttggaacagcrtaggtgaataaatgagcaattattttgtcctcagcactataactgatttgagaaggtcaaaacagaaaataaaaacatgtttcagtagtaccagttcctg

SEQ ID NO: 31748 - DNA, 201 bp, Homo sapiens
tcagcaatactctccagcagcaaaacccaatccgctcatattcttgcatttgctgcagcaaaacctgacctctctttgtgttacctgagtcttgacgaagwagactgaggaaaggcccccccccccccccaccaaattgtcccgttgtctcttggctggtcttgccagctggcacacagcttcctctgaccaccctgctag

SEQ ID NO: 31749 - DNA, 201 bp, Homo sapiens
tttatcccttctgttgatgcaattaaagctaatggatctcatatatatatatatatatatatatatatatatatatatatatatatatatatatttatatwaatatattttatatttaaaaatatttatattttatatatttttatatatttatgcaagtatatatctaaatatataaaatatatataaatatatacatat

SEQ ID NO: 31750 - DNA, 201 bp, Homo sapiens
cagccatgatgagcaatactctttttttgtttatttttgttgttactgctgtaagccactttcttctccctctccgttaaaatgcaacttaattggtaaartttagttgactagagatttcatttatttatttatttatttatttatttatttatttgtttgtttgtttgtttgagatgagtcttgctcttttgcccaagc

SEQ ID NO: 31751 - DNA, 201 bp, Homo sapiens
ttttacctctgcaagcctcagttttctcatctgtaaagtagggataacattagcttcagccctcacaggcttagagtgaagtttaaataagaaaaggtatstaggctgggcgtggcggctcacgcctgtaatcccagcactgagggaggctgaggctggtggatagcttgagcccaggagttcgagaccagcctgagcagc

SEQ ID NO: 31752 - DNA, 201 bp, Homo sapiens
actatcgtattcagcaaccaaaattttatcacttgcctgatactgcctggtgagcaggtggaaatgtagacacccaaacacccttcatggattcccagctsctgagagtttgaatagtatgtgaagtctgtagagacaaaattgttgttttccccagttgtaaagtgtgcaatattatccttgcaaaattgtctgtttatt

SEQ ID NO: 31753 - DNA, 201 bp, Homo sapiens
agccaagagaaagacagttcaccaaatctatcgattaatagaaatcatccagcagcagtgccactgtaagatgttcaatacgtagcacctttctgtccctyctcctctagccagttgggacaggattagcaagccaaagactttctgaaataatccttagctatattcttggtattcaccaaggaatttaccaatatgcaa

SEQ ID NO: 31754 - DNA, 201 bp, Homo sapiens
aatactctggagtggaatgggcagggtggtccgtatagggctatgtataactttttaagaggttggcaaatacttccctaaagtggtcatcccattttacrttcttgccaacagtgtttaaggatccacttcctctacatccttaataatacttgatattatcggtcttctaaattttctgtttgggtacatagtggtatt

SEQ ID NO: 31755 - DNA, 201 bp, Homo sapiens
tggatttcaactagataaggcccattttcatggatggacatgtgagttttcatctataatatagaatgctattttctagttaggttggagcaaaagtaatygcggttttcaccattatattcaatagcaaaaaccgcaattacttttgcaccactactttttacctagcagttcaacagctgtaaagaaagatgctgagct

SEQ ID NO: 31756 - DNA, 201 bp, Homo sapiens
tctgggcactgaattcagtcacaaaccctagcatgctcctttgctacctcaggggacaaagtcaagaaaataacactaggattgccaccctgctctctctstctctctctttttttttttttctttttgaggaagggtctctctctgtcacctggctggaatacaatggtgctatcttggcccactgcaccctccatctcc

SEQ ID NO: 31757 - DNA, 201 bp, Homo sapiens
agttttgaggacacactgtaaaaatgtatgacagcagtttgaagataagtctgttgccccaaataatcataagaagaagacagaagaaaaattgattcccrtagctctctgggcagtgggatgggggtaaagcaaggaattaataaaaacccaccagaatacattatttcagacaatcaaggagagcgttacattttaaag

SEQ ID NO: 31758 - DNA, 201 bp, Homo sapiens
aactcccaatctgaacggtagtcaaagaaggtcttcttctctttggagactgaaaggctgagagggtacctgccctgctaaggaaatgaacaggacggaakaatgatggagggagaatgggaagtcctcagcacataaaagtttgagctggaaatgaaatatacaactctgcatagtcagcagattttgctgggctgggcc

SEQ ID NO: 31759 - DNA, 201 bp, Homo sapiens
cttgggaggtggaggttgcagtgagccgagatcatgccactgcactccagcctgggcgacagagtgagaatccgtctcaaaaaataagtaaataaaataaytaactaggctaggcacagtgggtcatgcctgccatcccagcactttgggagtccaaggcaagaggatcacttgagcccaggatttcgagaccaacctgga

SEQ ID NO: 31760 - DNA, 201 bp, Homo sapiens; identical to SEQ ID NO: 8656

SEQ ID NO: 31761 - DNA, 201 bp, Homo sapiens
ataagcatgatttatgatttgattggaacattgtattttatggttgcagagcacacgtatcatcctatctgcttctgacacccagtaagcagctctggctwttataattttgatgaaagaagtttcccaacagtatttcggtgtgcatgctcacacaccagccctggtcgtcagtgaacagattcttccaggtcttcattg

SEQ ID NO: 31762 - DNA, 201 bp, Homo sapiens
gggtctggagatgtcacccttagctgtttttcacaatgagaggttgttttatcataaataaatcaataaatggcagattatacaccggagttactgagaawtataaaaaaaaaaaaagcccacattttaaagggaatttggtatttttaacaaagcatcagggggccgggagcagtagctcacgcctgtaatgccagcact

SEQ ID NO: 31763 - DNA, 201 bp, Homo sapiens
tcttcagcctagaatactcctcctccactcttaatttctacccatcctgcaaaactcagtctgaacagcacacgtcaaggaagcagttttggtctctcagrttatatgaagctctccaatatgttctttcagaacagccagtgcctagaatactgcctgactcgtagtagcactccttatgtgttgaatgagtaaatgaag

SEQ ID NO: 31764 - DNA, 201 bp, Homo sapiens
acagcggagacagtgaggtcctgtaggatgaggttggagagcaggaacttgcccgaggtcatgtgcagagttcgaggcagggcctggatgggaagcccagsatggagaccccaggccgtctctccgccatcttgttgtgatgcttccggaagaatgcctgtcactcttgctgacatccgactgaccaagtgggcaagagga

SEQ ID NO: 31765 - DNA, 201 bp, Homo sapiens
gtcgcattcacagatccctaccattcaactcactatggaagcaatgggatgggaggtaccattcaactcacagattcctaccattcaacccactataaagyagtggcatatgaaaaggatgggaggttgctatgggaatggtctgccccagatgcaggtaaaatggggaagcattttatatagaatggaaaaacaacagta

SEQ ID NO: 31766 - DNA, 201 bp, Homo sapiens
gtattgttgaaaactcttggtaggggttttttttttaattggctggaagcacttcatcatatagttgtaccaaagtttgcttaacatcccccttattactsagcctttgggtggtatccagttctttgctttgataaataatgctgagatgaacatctttctgcatggctctttttccttcttttgacatacttggagttc

SEQ ID NO: 31767 - DNA, 201 bp, Homo sapiens
ctaatgtgattgtctgtaggtctagcaattggaggttgttcgtttctttgagacaaggtctcactctgttgcccaggctggagtgcagtggtacaatttcrgctcactgcaacctttgcatcctgggctcaagcaatcctcccacgtcaacctccagaatagctaagacccaggtgcgcaccaacacacttggctaatttt

SEQ ID NO: 31768 - DNA, 201 bp, Homo sapiens
aggcagttttgctgtgttgcccagactggtcttgaactcttgagctcaagaaatccttccacctcagcttgacattacaggtaagagccaccgtgtccggsccccctttcttcttttttaaagtggggtattaaggctcagaaaagagtgtttctgccactgcagaggattgctgacattattagttgctcactctgtcca

SEQ ID NO: 31769 - DNA, 201 bp, Homo sapiens
ctctaatccataaaagccgtttgaaatttccattaggagatttgcacaagtggttaaaattagtcatgcattcttggtctaaactgcaggaagggtatctytactgtgaaaatgattatgacatgttaaaactgtgtaatagtaagcagacagttttccgagctgctgggtgaattctggaaatgctctattattttctcc

SEQ ID NO: 31770 - DNA, 201 bp, Homo sapiens
tgccctccttggcctcccaaagtgctgggattataggcgtgagccactgcacctggccagtagtagacttttgatagggtttttttttctcaaggtgtagrtttggctaggaagtcatagaaaatgctctttttttttttttggagatggagtctcactttgtcacctaggctggagtgcagtggtgtgatctcagctcac

SEQ ID NO: 31771 - DNA, 201 bp, Homo sapiens
aaatgctgttcaagccatacgtcaccattggaaggttgccaaactgtgctttgcacacacatgctgtctgcacgccttgtatttttctctttgcttagtcytgctcatgctctctaaacaccccagacatcatatctctttaagaaactctggctgagtcccataatgttctggggcaacttctgtcttcccttttccctc

SEQ ID NO: 31772 - DNA, 201 bp, Homo sapiens
gtgagccgagatcatgcctgggggacagtgagactctgtctcaaacaaattactccaaaatttagtggctaaaaaacaacataaaacaagaaacatttctkttgtgcctcctcttttcctccctccctctttctcatagttaatttgtttgaatcaggattcaaataaggtcgatgcatttttaatctataggttttgtct

SEQ ID NO: 31773 - DNA, 201 bp, Homo sapiens
gtcggtagatttgtttatgattttaatggctgcatagtattctatcatatggatatattctaaatgtaataattcctcaatggtatatttagtttactttwtatttgctgctttagtttgtcacaaacactgtggatagccttgtatatatttattttgttgtatagttcttattggtacagtatgatttttcacaagtat

SEQ ID NO: 31774 - DNA, 201 bp, Homo sapiens
tatttgccaaaggtctgagaaaaaaaaaagcctttcaccatggttagttcgagaagcacagcaatacagtacttctgctacgagtgtatacaggctgaggrtgggtgctttgtggcccttttcttttaccggctgactagaatgttgacgttaaagcagttagagtccgagcaggcaactccgaccccaagttggagctgt

SEQ ID NO: 31775 - DNA, 201 bp, Homo sapiens
tcctgagtagctgggattataggcacatgccaccatacccagctcatttttttttaatatatatttttagtgaaggcggagtttcaccatgttggccaggmtggtctctaactcctgacctcaagtgatccgcccatctcggcctccccaagtgctgggattacaggcatgagccaccactctaggcctgtatttgtttta

SEQ ID NO: 31776 - DNA, 201 bp, Homo sapiens
aggtcaaagacagctctttagaaagagatgttctttgcttctttgctgactgcccatcccctcctctctctcaaggaaataagatattcatttgcaagtawataatgcagcagtcttggatttgtatcagatcaactttgaatgaaagcctgcctttctgcgtttatttttgcttatctctcctgcttctgcttcctgttt

SEQ ID NO: 31777 - DNA, 201 bp, Homo sapiens
gcgatctcggctcactgcaagctccgcctcccgggttcacgccattctcctgcctcagcctcccgagtagctgggactacaggcgcccgctaccacgcccrgctaattttttgtatttttagtagagacggggtttcaccgtgttagccaggatggtctcgatctcctgacctcgtgatctgcccgcctcggcctcccaaa

SEQ ID NO: 31778 - DNA, 201 bp, Homo sapiens
ttatactgccaatctgaggccttttctgacctcatcgctgccactgtaaaatgaattctagccccagaccatgacatgcctactagcttagctctaaccaraaagatttattatcccaagagttgtgaaaatgtggaagaactagaactgtcattcactgctggtgggaatgtaaaatggtacaatgaatttggaaacagt

SEQ ID NO: 31779 - DNA, 201 bp, Homo sapiens
gtgcatatgagctttccctcctcccgtgggttagcatgttccacactcaccttctcaaagcaaagtctcccttaggggacccttggtatcctgttcatctrgcaaatctcagcaccaatagaaacaccaagaacatggattcatcaaaggaaaaatgttgaagtttccatttttatgcttcctggtaatccttcagccctt

SEQ ID NO: 31780 - DNA, 201 bp, Homo sapiens
gtcctgacaccatggccaccttccagaaatttccacatgttaagattgcagatgcaggctggacacattagtgatttctaagtgctaagaaaaaaaaagascggctcacacctgtaatctcagcactttgggaggctaaggtgggcgaatcaccccaggtcaggagtttgagaccagcctgagcaacatgacgaaaccctg

SEQ ID NO: 31781 - DNA, 201 bp, Homo sapiens
agaaagtgagatcagagatcccgaggaagggcttcagtttcaccagtagtggagctagggagtaggggggcagaagccgcaggaagtcagtgcaggacgcyggaggccactcctaattgcttcatgtgttgttgccgtgctgatgaccttggaggcgctgctggtcctggatccttgcgaccttttcttccaagaggaaat

SEQ ID NO: 31782 - DNA, 201 bp, Homo sapiens
tgacaaagatcatttgggagagattctttcaaaaatgcctactccctattcccatatcccagcctaagggaatgagtttaagtgggtctacagtgggtcckgggaatttgcttcttatctagcatccctggtgaatcttttcattcaagccaatgcaggaagtagtcctctgaaatacatgtccacagaacacgccgtgct

SEQ ID NO: 31783 - DNA, 201 bp, Homo sapiens
tgaccaatttttgtaaatctcttctgttactgtttatatacccggccacttctgccaaaatatgctggccttttagtcttttggttttttctctcttttgktttgttggcttatgttcgctgcttgatctgactactggttttatttctaaggatttttttttaagttggcatctttttttctttgactttccttgtatgc

SEQ ID NO: 31784 - DNA, 201 bp, Homo sapiens
tgataactgtggtacagtgtccctaccctaagcaatattgttggtcctttaagaatggttcatctgcaacctaaggttacatgggtgtagttaggccccaycctaaatcacattaagagtctccagagtatgatcagaggtgcccaagcaaacaaagactctttttttcaggaatatattctgcatatatttcagtgattt

SEQ ID NO: 31785 - DNA, 201 bp, Homo sapiens
tatgtacatatatatgtatatatatatgtggttttttcaaaaaaattgtgggcacttagtaggtatatatatttgtggtctgtgtttcttataaattggtratcccccaggggatgcctgccttgttggtccaggtaacacacttggagtagcaaacatctagacgtagttctcaatagtaggactattgccagtggaggg

SEQ ID NO: 31786 - DNA, 201 bp, Homo sapiens
aagaagccccactctccctctgccccacatctattgtgggctgggatacatgttgggcctctgcccagatcatgcttggagtggcaccagctgggtaggayatgtgaaatatttgctcagagagatccagaagtgttgatctgagtaggatcagctggtgctccaggataaaaatcgtgtcaccacttttgccgaaaagtc

SEQ ID NO: 31787 - DNA, 201 bp, Homo sapiens; identical to SEQ ID NO: 8657

SEQ ID NO: 31788 - DNA, 201 bp, Homo sapiens
acaacaacgaaaaaactcccatgtattatctatggattgactgtaaaatatgagaagcaataaatatgttcatcactagggccatctagaaatttctaacycaagggtcaactaatctttccctgtgttgtatttcctgctctgcggatccggcatcatgacctttgtactacccaggaaagccagtgttctcatgggctc

SEQ ID NO: 31789 - DNA, 201 bp, Homo sapiens
gaactctggagacagaggttggcgtgagctgagatcgcaccactgcactccggcctgggtgacagagcaagactctgcctcaaaaaaaaaaaaaaaaaaaraaaaaaaaaagattgaacatgtggaatatgagacaaatgaaaaagattgaattccgttccaactgggcttttgaatttattttcgcacttcctatttttt

SEQ ID NO: 31790 - DNA, 201 bp, Homo sapiens
ggagaattgtttgaagctgggaggcggaggttgcagtgagctgagatcgtgccactgccctccagtctgggtgacagagtgaaacccatcccccaaaaaartaaataaataaaaattaaaaaacctaacactggtacgagaagaaattatgctctaaatccttctttgagcagtggcttacagacctaaatttatcaaagg

SEQ ID NO: 31791 - DNA, 201 bp, Homo sapiens
aacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgt

SEQ ID NO: 31792 - DNA, 201 bp, Homo sapiens
agtgattcttctcactgtattcttttttattaagattattttagcttcctaagacctgtgctttttcatataaattgtacaatatggttgtctatgtctaycagaagccttgctgcagttttaatggggtttaaatctataggtctaacattaaacctatagatcaattcgggagaattgacatctttactatgttgagtc

SEQ ID NO: 31793 - DNA, 201 bp, Homo sapiens
ttgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgt

SEQ ID NO: 31794 - DNA, 201 bp, Homo sapiens
cttctccatgccaggatccagagtaaaagcacagcttctctctaggactccaggggaaagagaaaagacaagttcttaaagtttcttccaggacgtgacasctgacatttcactggccaaacacagtgacctggtcactctggggcagggatgtgtaatctccccatagctggagaagtaaataataatgcacaataacat

SEQ ID NO: 31795 - DNA, 201 bp, Homo sapiens
gattgaagagaggaagggaacgttggaaccaatgctgatgagccattcataggctctggctcactatatatgtctaaaattcacatgcccctaaccctcarataatgaccattaataatctggcaggagaggaaagacctgcagctcttctagtccttatgctatctcattgtctcatggatttttaatatgtctttgcat

SEQ ID NO: 31796 - DNA, 201 bp, Homo sapiens
tgacctaaactcctggctacaagtgatcctcttgccttggcctcccaaagtgctgggattacaggtgtgagccaccatgcccagccttaaataaactcttyagtgtcaaaaaatctacgtgaggccaggtgtggtggcttacccctgtaatcacagcactttaggaggccaaggtgggtgggtcatctgaggtcaggagtt

SEQ ID NO: 31797 - DNA, 201 bp, Homo sapiens
gactctcagattctggcacatagtaaagattcagtaaatggtcgttgcagggaaagctaacttgtccaatgcagatctgtaaaatatactcataaatcttkttggagcaatatttcttctttgtcttacttcgggctaataacaaaaatatcatacaatgagtggcttaaatatttattcttacagttctagaggctggaa

SEQ ID NO: 31798 - DNA, 201 bp, Homo sapiens
ttgaagacatttactatttctatggtttgtttagcaacagcctggctgaatagttcttcaaaaaataggaacatgatgctcatatctggccactgtatatrctttggagggaacttgaagactaggtggctgcagccactcagaatcttgttgaatatttaacatttttttgtgaatgtatcaactaagaagactatcaat

SEQ ID NO: 31799 - DNA, 201 bp, Homo sapiens
gacttgtatctcttaatgagtttaactacatttaaccatgtatgtgtcagtcctactatgcaccttacagctcactaaccctgtttaataatgtatgttgytacatttaatctttatggtagcctcatgaacaggctcttatttagttcagtggttcttgatcaggagtgatattgcctgccagggaatgcatgtcaatgt

SEQ ID NO: 31800 - DNA, 201 bp, Homo sapiens
ccgccaccacacccagctaatttttgtatttttagtatatacggggtttcaccatgttggccaggctggtctcgaactcttgacctcaggtgatctgccckccttggcctcccaaagtgctgggattataggcgtgagccactgcacctggccagtagtagacttttgatagggtttttttttctcaaggtgtaggtttgg

SEQ ID NO: 31801 - DNA, 201 bp, Homo sapiens
aaaagattagtttgaaaggaagggacttgggctcttgaattagacctatgttagtttatagggaggccttcctgaaatgtgttgtcaggcttgctcctgtstgatggctggcactggttttatgctttccaattattctttgcacatcgttatttattattactgttattattatttgacatggagtcttgatctgttacc

SEQ ID NO: 31802 - DNA, 201 bp, Homo sapiens
tacaggcacgagctgccacgcctcacctcttgttttcaataccattgataagttgtggtcttcagggacttgtgggcattttcaagttaaatatccaacaktcgtgatttagggcatgaagagctcactcatcaagatgtatgtaattcagattttctgagtgtttaattcggcgtctttggtcacaaggaacagagtttt

SEQ ID NO: 31803 - DNA, 201 bp, Homo sapiens
aaaaaaaaaaaaaaagcctacagttgacaggcagataacagagggagcaaaggagtcttgtggaagacaatagggagtgttgaggacctgtcaaacaacasagtccccatctgtactttgggagggaaggacttcttaattccagctgcctgttgccatgggggaacatagacccagaactgccatcttttctaatttttt

SEQ ID NO: 31804 - DNA, 201 bp, Homo sapiens
ctgtaccagtttggccatgttttgtgaatctataattagtttcaaataaaagttaacaaccagaagatcacgagctaaaccaataaagtgaattatggtcmgttgcagattcactgccagacctgggaggaaatctcaccttggcagatcgagtctcttgtcctcgcctaacaatcagcagttcacctctcgaaaaggggt

SEQ ID NO: 31805 - DNA, 201 bp, Homo sapiens
gcccatgttcctcgatccatggctccttttcggtcaccttccagccagcaacattgggctgactccttcaatggccatgtctctggttctttgtcttttgyctcctcctcttacttttaaggacccttgtcatttcattggtctcagctggatagctatcaagggtcactttaaggtcagctgactagcaaacctaattct

SEQ ID NO: 31806 - DNA, 201 bp, Homo sapiens; identical to SEQ ID NO: 8658

SEQ ID NO: 31807 - DNA, 201 bp, Homo sapiens
cctccccagattttttttagaactggaagtttccatttcctggcactggtgaaagctctaggacataaaacttgggagccgatggccttcaggctgcccayaatgtgaagagaggtcatttcagacattcagataaagtctgtggctccagtatttttctaggtcttgctccctccctgaccttttcacagtttggtgaca

SEQ ID NO: 31808 - DNA, 201 bp, Homo sapiens
cacgacagtaacaaatatcttagccaacagaacaaaaaatgttcctggtgagaacagccagggattctggaattgactgctgtagttcagaagagatttgscttcccacagggcattgtagagctttatgctgaaaaggtggccccagaggtctgtgtgccattgcccaggtcgagtctgcagtacaaactcctaggaggg

SEQ ID NO: 31809 - DNA, 201 bp, Homo sapiens
cttttttcttttttgagacagggtctcgctgtgttgcccatgctggagtgcagtggtgcgatcacagctttctgcagcattgaccttgtgggctcaagcartcctcctgcctcagcctcccaagtagcttagaaccacaggcatataccaccatacctggacatgtttttaactttaatttttatttttgtagagatgagg

SEQ ID NO: 31810 - DNA, 201 bp, Homo sapiens
caggagtttgcgaccagcctggctaacatcatgaaatcccatctctacaaaacataaacagaaattagctgggcattgtggtatgtacctgtagtcccagstactcaggaggctgaggtgggaggattgcttgagcctgggaagtcaaggctgcagtgagcaaagatcacaccactgcagtcaagcctgggtgacagggca

SEQ ID NO: 31811 - DNA, 201 bp, Homo sapiens
ttgtcctgcctcagccttctgagtagctgggattacaggcgcccgccaccacacccagctaatttttgtatttttagtatatacggggtttcaccatgttrgccaggctggtctcgaactcttgacctcaggtgatctgccctccttggcctcccaaagtgctgggattataggcgtgagccactgcacctggccagtagt

SEQ ID NO: 31812 - DNA, 201 bp, Homo sapiens
ctgcttattttgatttcagcacctttctgtaggacgccaatagcttatgtttgcacatcttaccccgatgcactctctaaaccgatcatcacagaagataytttgtagtgatgaagaaagcttaaatgtctcatttgtcagattggtttaggtagaaaataaggatttccaccccctcatcgtggttcccttttagatttt

SEQ ID NO: 31813 - DNA, 201 bp, Homo sapiens
agatttgtgaggggcgggggtccccctacaaagcaagtgttactgtccacagagcaaatgtcaatattttaatgtactagtaagggaaaattctattaagrcataattgtttggctttgtcagtttgtcaacttgaaaatagagtcagcagcatctaaagagttgttttactacctctggagctgagaggtgaacatagtc

SEQ ID NO: 31814 - DNA, 201 bp, Homo sapiens
tgaatggaccctgagtatcttagaatcttctgaaataatatgcagcattatattccatttgtacctgggaagagggtacttgtctttcatcagagagtcaycaatggaccactggtccctgctgatttagtgtcacagctcaaaaccatcagtagtcctcgtgatctttcggcattgtggctccctttgtgagaagggcct

SEQ ID NO: 31815 - DNA, 201 bp, Homo sapiens
gtgaatctcccaaccataagctgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggc

SEQ ID NO: 31816 - DNA, 201 bp, Homo sapiens
cactgtactagttttctattgcttcataaacaaactatcacaggcatagtgagttggaatgatggctctcaaaaaactatgtccacatcctataaatgctrttgtacaatatatggtcttttgtgattggcctcctccacttagcgtcgtgtttttgaggttcagccacagttgtagcatgtccatctctctttgtgtggc

SEQ ID NO: 31817 - DNA, 201 bp, Homo sapiens
atagtgagttggaatgatggctctcaaaaaactatgtccacatcctataaatgctattgtacaatatatggtcttttgtgattggcctcctccacttagcrtcgtgtttttgaggttcagccacagttgtagcatgtccatctctctttgtgtggctgaatatcattgcattgtatggatataccaaatatttttctcctt

SEQ ID NO: 31818 - DNA, 201 bp, Homo sapiens
aacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagc

SEQ ID NO: 31819 - DNA, 201 bp, Homo sapiens
gaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttggttttaacaataatggtttttaaaaaccgtaggt

SEQ ID NO: 31820 - DNA, 201 bp, Homo sapiens
cagcctgggcgatgagtgaaactccgtctcaaagaataaacaagaattgtgtctggcctttgtgatagttactcaacaaatcatatctgtgattgttttgrttttaacaataatggtttttaaaaaccgtaggtgatcacatactacgcagaaagggaagcagttacagcattcacagcatccgtgagtcatagactcact

SEQ ID NO: 31821 - DNA, 201 bp, Homo sapiens
tactcaacaaatcatatctgtgattgttttggttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctc

SEQ ID NO: 31822 - DNA, 201 bp, Homo sapiens
cccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctat

SEQ ID NO: 31823 - DNA, 201 bp, Homo sapiens
cactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgcggaactaatttttatactgccaatctgaggccttttctgacctcatcgctgcca

SEQ ID NO: 31824 - DNA, 201 bp, Homo sapiens
cctcacgagtagctgggatttcaggtgcctgccaccatgcctggctaattaagtgagtttcttaaagtcctacaactggtgagctgtgagctgtaaattgyggaactaatttttatactgccaatctgaggccttttctgacctcatcgctgccactgtaaaatgaattctagccccagaccatgacatgcctactagctt

SEQ ID NO: 31825 - DNA, 201 bp, Homo sapiens
tgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactatcatcaaactgtatatttacaatggttaaatcatatggtatgt

SEQ ID NO: 31826 - DNA, 201 bp, Homo sapiens
tagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatct

SEQ ID NO: 31827 - DNA, 201 bp, Homo sapiens
catcgcccactctgatttagatgagcaagagctgctgagttgtagatttctagtttctaaacaacaataagtcttgcccccagatagcctcttagcagagycaaaagccagcagagagaagactcagcatttgctttggagtaagtttgtgtgtgtatgtttatctcccttttactcatgggctcttttttcccaaataac

SEQ ID NO: 31828 - DNA, 201 bp, Homo sapiens
actacaaatcattgatcaaagtattggtctgtcacctgtccatgtgtaaggccaggcctaagtgctctgacagggcatgactcaatcctcaaacaggaagsgggaaattgctttccatctcctaaccctaagatcctggatggcaggtaatctgcttcctcaagattctgttgatacacattcaggactctggtttctgtt

SEQ ID NO: 31829 - DNA, 201 bp, Homo sapiens
caaagtattggtctgtcacctgtccatgtgtaaggccaggcctaagtgctctgacagggcatgactcaatcctcaaacaggaagggggaaattgctttccrtctcctaaccctaagatcctggatggcaggtaatctgcttcctcaagattctgttgatacacattcaggactctggtttctgttttgcttgatgacaatg

SEQ ID NO: 31830 - DNA, 201 bp, Homo sapiens
atacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttg

SEQ ID NO: 31831 - DNA, 201 bp, Homo sapiens
tattttagtagagacgggttttcaccgtgttgcccagggttgtctcgaactcctgagcttaggcagtctgcccacctcagcttcccaaagtgctaggattrtaggcatgagccaccatgcccggcctaatctaatcaattcctttaaatctgaaactgtccgcctgattctggtttaccacaaccaccagagtcttaagtg

SEQ ID NO: 31832 - DNA, 201 bp, Homo sapiens
aggcagtctgcccacctcagcttcccaaagtgctaggattataggcatgagccaccatgcccggcctaatctaatcaattcctttaaatctgaaactgtcygcctgattctggtttaccacaaccaccagagtcttaagtgtcccaatagccagggtctcatagactctgcttatggttaattcttctggggaaattaatt

SEQ ID NO: 31833 - DNA, 201 bp, Homo sapiens
gtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaatt

SEQ ID NO: 31834 - DNA, 201 bp, Homo sapiens
ctctagtctagggcacaaaatttctgtcaacccttctaaccagtgtttgaagtacgtaagacgttcatttccacttctaatgaggaattagaggaacggawttataaaggaattctggttataattgcatgtacttttagagacgatgtctaacagtgcaacccatagaaccaggctgcctggattcaaatcccagctctg

SEQ ID NO: 31835 - DNA, 201 bp, Homo sapiens
ggtctcccaccctctcttatttttataaacaggctccatggtactatatacactgcagatggacagctgccaacctgctctttttgtgctgaggaactctrgatatttcaactagtttacatgactttcttacctacgctaccttataatccttttataaattttgctttacgttttaacaacggaaaacacttaaggttt

SEQ ID NO: 31836 - DNA, 201 bp, Homo sapiens
catggtactatatacactgcagatggacagctgccaacctgctctttttgtgctgaggaactctggatatttcaactagtttacatgactttcttacctaygctaccttataatccttttataaattttgctttacgttttaacaacggaaaacacttaaggtttttttcctttctttttttttttaattcttccgccagc

SEQ ID NO: 31837 - DNA, 201 bp, Homo sapiens
tcccatttcaggctgattaaaaggcaaaatcttcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctcc

SEQ ID NO: 31838 - DNA, 201 bp, Homo sapiens
tcttcttcagctgttcctcagacatgccaggtgtgttcctgtctcagacgctttgcctttgctgctccttctgcctggagtattcttccacgtagcaccaygagctgttcttctccaaaaggctttgctcaactgacactttctcagtgaagctgtttctcaccactcactataaaatggcagcctgcctctctgagcctt

SEQ ID NO: 31839 - DNA, 201 bp, Homo sapiens
cataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccaga

SEQ ID NO: 31840 - DNA, 201 bp, Homo sapiens
tttataggctctagcaggtcccttctctttgcgtcaccagagaggaagatcccctaagacaaagcattccctgtagtttttagcataactagtactggctsagtaagtatccactggggttcggaatacaactgccctgcctcttgagcagccatgcctgcttccgaggtggtgctgcatgctattcaggaggacagacca

SEQ ID NO: 31841 - DNA, 201 bp, Homo sapiens
ttttagcataactagtactggctcagtaagtatccactggggttcggaatacaactgccctgcctcttgagcagccatgcctgcttccgaggtggtgctgmatgctattcaggaggacagaccatggatgggaatcctgagccacaactccttagcctcatgacgttgggcagatgactgagcttgtctgagttacaataa

SEQ ID NO: 31842 - DNA, 201 bp, Homo sapiens
cggaatacaactgccctgcctcttgagcagccatgcctgcttccgaggtggtgctgcatgctattcaggaggacagaccatggatgggaatcctgagccasaactccttagcctcatgacgttgggcagatgactgagcttgtctgagttacaataaataaaaataccatgctgaatgatggcctagcatgacattgggaa

SEQ ID NO: 31843 - DNA, 201 bp, Homo sapiens
tgctattcaggaggacagaccatggatgggaatcctgagccacaactccttagcctcatgacgttgggcagatgactgagcttgtctgagttacaataaayaaaaataccatgctgaatgatggcctagcatgacattgggaagtacagactttgcaggcaggcccctgggttcaattcctgcccctgtcattgagtaaag

SEQ ID NO: 31844 - DNA, 201 bp, Homo sapiens
ttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagac

SEQ ID NO: 31845 - DNA, 201 bp, Homo sapiens
gatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacaccagtaccaaacgaagatatc

SEQ ID NO: 31846 - DNA, 201 bp, Homo sapiens
aaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttc

SEQ ID NO: 31847 - DNA, 201 bp, Homo sapiens
aacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaa

SEQ ID NO: 31848 - DNA, 201 bp, Homo sapiens
gagaaggcagcatttttagtagtactgttgagcctgcatgtagcttttccaggagggcagggtgcctggatatctgatcttacagttattactttgtgtcrtatataattttgttttctccctgcaacaaataaatctttgggactccggaagaaaaaaaaatgggaaagaaaaaaaaaatttgtggttacagtataataa

SEQ ID NO: 31849 - DNA, 201 bp, Homo sapiens
gaagtacttttcccaacaatcggttccgctgtcctgctgtgaccagtaacaggggaaaaaaataaaactcccctaaaggtaaatgattcacctcatgaacraagggaagaataagagacctaagtttatatacacagattccaattgtaaaatcaaacctattttgttttctaaataaacaatatttgaaaatacaacatt

SEQ ID NO: 31850 - DNA, 201 bp, Homo sapiens
aatgatgtaacctacttgaaagtgtcatataaattctgaggtgaagtggaggcattatggatgcattttattttgttttattttatttcatttattctttytttgaagagctatgggtcaagcagatctgcagcccacactcggctcactgatcacgtcccatacaatcttggcagatacttagctgaattccatcgattt

SEQ ID NO: 31851 - DNA, 201 bp, Homo sapiens
cgaaagagcacagcttctggaagtgtggtatgtggtccctgagatgaagcagcagccacaggaacccatcattcctgctacccaaggcctccattgcctgrttttctgttgtcagaagagttcattttcaggtccttcaccagatattttagaagctcatcaaggaaaggacgtttgaagaaaaacaaataaacaaaaaca

SEQ ID NO: 31852 - DNA, 201 bp, Homo sapiens
caatggcctggacgcagctgaaaaaatccagaagagtgtaggacactggaaaagtagcagggtgtgcgattgcagggatgggaccagcagtaaaaggtagscctgccaagaccattaagcttcctgcaactccttctggatcccacaatttgaaggggaaatctttcccaccgcacatcactgtttggtggactaaatggc

SEQ ID NO: 31853 - DNA, 201 bp, Homo sapiens
tggggcaacgctaccaacattggtattccacagcattccaacgattctaaatactctcccagagtagggaggaaaaatcatccaaactacttggtaattgrattcaagagtgatggaccaaaaattattaatgcattcccttccgtccaccagccaaagaggattccatctttattctcctcccaaatgcaggctccatta

SEQ ID NO: 31854 - DNA, 201 bp, Homo sapiens; identical to SEQ ID NO: 8659

SEQ ID NO: 31855 - DNA, 201 bp, Homo sapiens; identical to SEQ ID NO: 8660

SEQ ID NO: 31856 - DNA, 201 bp, Homo sapiens
cgcctcctgggttcaaacaattctcctacgtcagcctcctgagtagctgggattatagtcacctaccaccatacccagctaatttttgtattttttagtaraaacagtgtttcaccaggttggccaggctgctctcgaactcctgacctcaggtgatctgcccaccttggcctcccaaagtgcagagcaggaatttcattg

SEQ ID NO: 31857 - DNA, 201 bp, Homo sapiens
ttatttatttatttatttatttatttatttatttgtttgtttgtttgtttgagatgagtcttgctcttttgcccaagctggagtgcagtggcatgatctcrgctcactgcagcctctgcctcccgtgtccaagtgattcttctacctcagcctcccgagtagctgggattacagttgtgcaccaccaggctctgctaattt

SEQ ID NO: 31858 - DNA, 201 bp, Homo sapiens
taaatggcagattatacaccggagttactgagaaatataaaaaaaaaaaaagcccacattttaaagggaatttggtatttttaacaaagcatcagggggcygggagcagtagctcacgcctgtaatgccagcactttgggaggccgaggcgggcggatcacaagatcgggagatcgagaccattctggctaacatggtgaa

SEQ ID NO: 31859 - DNA, 201 bp, Homo sapiens
tttccctatgttgcccaggctggtctggaactcctgtgctcaagccatcctcccacctcagtctcacaaagtgctgggattacaggtacaagccaccatgycaggccattggtataccattgtttttcttaaacatttatttattttcttatatttacagcatatgtggtcatttaaaattattttatagcatataaaagt

SEQ ID NO: 31860 - DNA, 201 bp, Homo sapiens
cacttagtgttccctagtcatgacatacttctgtgttatccttaaatactgaaacagggaccttattcttaacagtagaaaatcactgtgtatgatgatartgtatacctgtaataccagctactcaggaagctgaggcaggaggatcccttgagctcaggagttgagattagcatgggcaacaaagcaagaccttgtctc

SEQ ID NO: 31861 - DNA, 201 bp, Homo sapiens
aaggccaatgcgggtggatcacctgatgataggagttcaagaccagcctcaccaacatggtgaaaccctatccctattaaaaatacaaaaattaacaggcrtggtggcgggcatctgttgttccaggtactcgggaggctgaggcagcagaattgcctgaactcgggaggtggaggtagcagtgagctgagatggcaccac

SEQ ID NO: 31862 - DNA, 201 bp, Homo sapiens
aacattctaaaattagatgagggtgttttttttttttttctttttgagacagggtctcactctgttgcccaggctggagtgcgatggcacaatctcagctsattgtaacctccacctcccgggttcaagcgattctcctgcctcagcctctctagcagctgggactacaggcgcctgccaccatgcccggctaacttttgt

SEQ ID NO: 31863 - DNA, 201 bp, Homo sapiens
tcactgtcttttgcattatgtcatgggtggaaacatgcaccttccctgaccttttggcttggaacatggaagttcattgactttgttgcctagcagggcckggagctgggtttcttgcctgatcaatgtatatcattttgccaagagacagagtctgtgctggagagattgattccctggttatttatcttcctctgccca

SEQ ID NO: 31864 - DNA, 201 bp, Homo sapiens
tctggcagagaaacaatattgtgaatggaaatgggaggaacttgggtcctgaaaattacaccataccccagagcctggggtggattatttcaggacctttyttccttccttccttccttccttccttccttccttccttccttccttccttccttcctttctctctttctttttttattttttttttcagacagggtctcc

SEQ ID NO: 31865 - DNA, 201 bp, Homo sapiens
gcgatctcagctgactgcaacctccgcctcccgggttcaagtgattctcctgcctcagcctcccaagtagttgggattacaggcacatgccaccactcccrgctactttttgtatttttagtaaagatggggtttcaccacttttggccaggctggtgttgaacccccgacctcaggtgatctgccctcctcggcctccca

SEQ ID NO: 31866 - DNA, 201 bp, Homo sapiens
cacaccactgcagtcaagcctgggtgacagggcaagaccctatatcaaaaaaaaaaaaaaaaaaaaaaatatatatatatatatatatatatatatatatrtatatgtatatgtatatataaatttaaggaagcatagaattgaagaggctattccaaggtcacatgacttttaagtggcagaaacaggggaattctgtct

SEQ ID NO: 31867 - DNA, 201 bp, Homo sapiens
tgtcattttatagtgagttgtattacttgctaggtgagctggtatctcctttgataacacaaagaaggcctgggtttgcttggcaatttgttccaatattsttttcagttttaaataagttttgaacaaaaagttttagcattttacataaaaacctctaaagctctcaggctaattagtaatgtagcatatacaaattaa

SEQ ID NO: 31868 - DNA, 201 bp, Homo sapiens
gtatgagtgggtcaagaacaagattcggccccaaggagatacgcgactttctactttgttttctatttggatttcacacaaaggctcgaaggtctcctggkaggccatgctcagaagtctgggttgtcccctgcccaggacaggctcaccctggcctgtgtcctaggtattgtggggccgctgtaggaggatggtggttaa

SEQ ID NO: 31869 - DNA, 201 bp, Homo sapiens
ccaaaggtctgagaaaaaaaaaagcctttcaccatggttagttcgagaagcacagcaatacagtacttctgctacgagtgtatacaggctgaggatgggtsctttgtggcccttttcttttaccggctgactagaatgttgacgttaaagcagttagagtccgagcaggcaactccgaccccaagttggagctgtgtgttg

SEQ ID NO: 31870 - DNA, 201 bp, Homo sapiens
ttgtatcatctgaattatttccatatccataatgtgcaaggatatccttccatgttattagaaatacagatacaccatcattatcagtggccaaatcattmaaatcgctgtttgcttcttctcgggctcttattcaagctcacgatgctattctcatagtgattgcgaatctcactgcataaaggtgattttgaaaacatc

SEQ ID NO: 31871 - DNA, 201 bp, Homo sapiens
cactcccgcccgggtgacagagcgagactccgcctcagaaaaaaaaaaaaaaaaaaaaaaaggaaccagatggccctgcccttgagcaggctgtggtctgkcctggtggagagacagagaatcagttaattccagggtcatgtattaggtagtaagatagtggttcacaccaaaaacatagaaaatgatcacttagcctga

SEQ ID NO: 31872 - DNA, 201 bp, Homo sapiens
acacttacatttaaatacaggcctttcccatttcacagtgtttctagctcccctttccaatacatctctctctctctttctctctctctctctctctctcwcacacacacacacacacacacacacacacagccaaatcagacaccaacataaactgtagagttaacattctttttccaccctcacactttttttagctcc

SEQ ID NO: 31873 - DNA, 201 bp, Homo sapiens
cctcccgagtagctgggactacaggccaacgccacggcacctggctaatttttgtatttttagtagagccggggtttcaccatgttggccagggtggtctygaactcctgacctcaaatgattccctgcctccacctcccaaagtgctgggattataggtgtgggccactgtgcccggccaggaagatggtcatgttttac

SEQ ID NO: 31874 - DNA, 201 bp, Homo sapiens
gagcaatgattccagaagtttataataattggaaagtgtattagtcgattctcacactgctataaagacattcctgagactgggcaatttataaagaaggraggtttagttggctcgtggttctgcagactgtataggcttctgcctctcgggaggcctcaggaaacttacagttatggcagaaggtgaaggggaagcagg

SEQ ID NO: 31875 - DNA, 201 bp, Homo sapiens
ggccttcctgaaatgtgttgtcaggcttgctcctgtgtgatggctggcactggttttatgctttccaattattctttgcacatcgttatttattattactrttattattatttgacatggagtcttgatctgttaccaggctgcagtgcagtggcatgatctcggctcaccacaacttcagactcccagggttaagcgatt

SEQ ID NO: 31876 - DNA, 201 bp, Homo sapiens
gtaattagatgccctttagatgctcttagttaaagaccatgcaaaaaggatgaaatcttttgatcatgttcttcacaatattagaggtaaaacatgaactsaacgcttttaggaagaaacaactggattgcgttttctattttattgacagaaactagatggggaggccagggtgtgttttattattgcacacatacgtaa

SEQ ID NO: 31877 - DNA, 201 bp, Homo sapiens
cctttctcagcattccacaagttacttcgtccttcctttgttctcctctgcctttgcctcttttttctttttttattttaattttttttttttaattatastttaagttttagggtacatgtgcacgttgtgcaggttagttacatatgtatacatgtgccatgctggtgcgctgcacccactaactcgtcatctagcatt

SEQ ID NO: 31878 - DNA, 201 bp, Homo sapiens
tcggatagattctatctctaaaaactacagattctatctctaaaaacttaagtcaagggattttgaagcagttgtttgatttatgtatgtgaacctctccsttaggagaagaacttttctttggcaaacaccataggaacggagaccttaacaaaagaattaggactctcttgtcctgttttaatctcaaagctgtccctg

SEQ ID NO: 31879 - DNA, 201 bp, Homo sapiens
aatgagcctacacagaatgtcgcatgcagatcaatgagccaaatgttagcaggggactgggcatttgaagatttaaaaaaatgaaaaattgcactgtgacrttgctggttcctattagcaaaataacagacagtgttatcagtcattgactcagaagatagtttcttaccgtttggggaaagtgcttgtctattcctctcc

SEQ ID NO: 31880 - DNA, 201 bp, Homo sapiens; identical to SEQ ID NO: 8661

SEQ ID NO: 31881 - DNA, 201 bp, Homo sapiens
aacagagcccccatatgttttaactgctcattggaaactgactaggtcacatactcctcctccttccctgtactggtagtttttcttttattttttttttwaatttcttccattttctttcctttttacagcaaatttgtagttatggtggagcaaagggcagttttcactcctcttccctaaaactgtagtttaactaaa

SEQ ID NO: 31882 - DNA, 201 bp, Homo sapiens; identical to SEQ ID NO: 14869

SEQ ID NO: 31883 - DNA, 201 bp, Homo sapiens
ttccaagaagggagtggcactatagctgaagaggatgaccctctatcacagcctttgctaaaaccactgaaaactgtcttatttttcattttgcccggaartgcgacacataagtgcattcctctagggaaggatttttttttttttttttttttttgagacaggagtctcactctgttgtccaagctggagtgcagtggc

SEQ ID NO: 31884 - DNA, 201 bp, Homo sapiens
gaggccctacctccaaacaccatcttattgggtgttctagtttaacatatgcatttggaagagagaggaacatattcagtccatagcatgaaccaaccacrtgcacagaggtgtgccccaatttactgtcagtgcagccttcacaggcaggaaacccaccaggtccaaggaaggggcactcagctgttacctcctgtcata

SEQ ID NO: 31885 - DNA, 201 bp, Homo sapiens
agactaatacagtcagggatgctgcagaacatctccaaacacacaggactcccaccctctacttccaccccaccaacaaagaatgattcagcccaaaatgrcagtagtgaccttgttgagaaatgctgttcaagccatacgtcaccattggaaggttgccaaactgtgctttgcacacacatgctgtctgcacgccttgta

SEQ ID NO: 31886 - DNA, 201 bp, Homo sapiens
ttatgtaagacagaaggtattgtgcagtagccttgaagtcaggtgaccctttgggggtgtgtgtgtgtttgcttctttatattagcttttttttcattttragacagggtgttgctcttcctcagttgcccaggctggagatcagtggggtgattacagctcactgcagccacaacctcccaggttcaagagatcctccca

SEQ ID NO: 31887 - DNA, 201 bp, Homo sapiens
gtcagaatgttatcctgctcagatggttgcatgggacagtgtccagaggaaggcctctgattccttccccagcattaggcaatattcaagtcttcagttcyatgtgtaggggagaagactttccttctgctccctaatgacagtggtacccacacccgtattccaccataaaatcttttttattcagtattaggaaaaaag

SEQ ID NO: 31888 - DNA, 201 bp, Homo sapiens
agagaaaaagacacagatgaggctattgggattaagggaaaatcaagtaaatcgagaggtaaagcactgtgcagaaatattggccagaagctatgaacagwtgccacagctgggctgaagagttacctgtgagccttccaggggtgtaagccaagagaaagacagttcaccaaatctatcgattaatagaaatcatccagc

SEQ ID NO: 31889 - DNA, 201 bp, Homo sapiens
ttaattttttttttttaattatactttaagttttagggtacatgtgcacgttgtgcaggttagttacatatgtatacatgtgccatgctggtgcgctgcasccactaactcgtcatctagcattaggtatatctcccaatgctatccctcccccttccccccaccccaccacagtccccagagtgtgatattccccttcct

SEQ ID NO: 31890 - DNA, 201 bp, Homo sapiens
ggacctttcatggaatccagggcttgagctttaatgctttacacttttgttttttcattccatacgcttttgctttagcttcctggcaaaattcagacaamcctagaagggataataacttacattcaacctctgcttgctctgtcctttctcacacgtgtttagagaaactggaggagcccgggaactgctttctcctct

SEQ ID NO: 31891 - DNA, 201 bp, Homo sapiens
acatcttgaatgcttctgtgtcattttcctttctttttttttttcaaagcacttaattatttaaaaacaaaaatacttctctgatcagagcatacctgccrtgctcaaagcacttgcttacttggaatgccataaattacatgaaggaattattcattgtatcacgaaacataccttccagtctcccgagtagtgtattag

SEQ ID NO: 31892 - DNA, 201 bp, Homo sapiens
caaattatgaaagtaaggtgggaaggcaatgaaggcaacaaagtatataaaacacacacacacacacacacacacacacacacacacacacacacacacayaagaaatgactacagacacctcaacacccttccaaaacacttgaatcattttcttcgggagttgaacaagtggctgaaaatgccaaaatccatcagccaa

SEQ ID NO: 31893 - DNA, 201 bp, Homo sapiens; identical to SEQ ID NO: 8662

SEQ ID NO: 31894 - DNA, 201 bp, Homo sapiens; identical to SEQ ID NO: 8663

SEQ ID NO: 31895 - DNA, 201 bp, Homo sapiens; identical to SEQ ID NO: 8664

SEQ ID NO: 31896 - DNA, 201 bp, Homo sapiens
actgggaagataagctaaaaagaagacaaagcaggaaggtaattttcccctggagctatgccatcaagctgttcttctgaagtccagccgcttctctccarctgtggtctctaatttccagctgcttctcctcttttcttcaatgtgccagcggagcctggggtttttatgggtacaggattgggggcaggccgggccatg

SEQ ID NO: 31897 - DNA, 201 bp, Homo sapiens
ttgagacggagtcttgctctgtcgcccaggctggagtgcagtggcgtaatctcggctcactgcaagttctgcctcctgggttcgtgccattctcctgcctyagcctcccgagtagctgggactacaggtgcctgccaccacacctggctaattttttttttttttttttttttgcatttttagtcgagacagggtttcacc

SEQ ID NO: 31898 - DNA, 201 bp, Homo sapiens
atatatatacgtatatatatgcgtatatatatacgtatatatgcgtatatatatacgtatatatgcgtatatatatacgtatatatacgtatatatgcgtrtatatatacgtatatatacgtatatatatatgtgtgtatatatatatataaaaatatatttaaataatgttaaggctagagtagaatgacatcatgggaa

SEQ ID NO: 31899 - DNA, 201 bp, Homo sapiens
cccttagcctttctttcagcctgtgaggaagcaaaacttttactcttcaggcatcacctcacgcgtcttttctgcctgggaggcactttttccagttttcytggcgaaatagtcatcttttaagttctctgacaacccctctctgagcatctaatcccaatcagaattccctcctaatgtaaactctcattatatctttta

SEQ ID NO: 31900 - DNA, 201 bp, Homo sapiens
aaaggttctggttatgaactcacagaggaagtgacggctgaactttgtaaggacacaagtggtttaacaagtttcctggcccatatgagatctcggctccracgttacaggcagcagtgtggggcctcaccttaccttttcccacttccatccttctccacccccgttcagttcccaggctccccttgtgtgaactggctc

SEQ ID NO: 31901 - DNA, 201 bp, Homo sapiens
tcttccctgaggttgctaattgtgggcagtacagtgtagagtcactttgatttttctcatctccttcctggaatgtgccacagaagaaaacccacgaagtsttgagctaaacgaagcagagatgggagaagggacaaggtgggaggcggtagtggtgctgcatgggataaaaatggaaacacacacttttgccctctgtac

SEQ ID NO: 31902 - DNA, 201 bp, Homo sapiens
ctgtgcagcaattttaactttctatattcaaatatactctgaatgcacagtgaatttggcagaataccatttaagtcttgtattttccaaagctagtcaaygtccaactgccaatgttgcctgaacaggaaatatttatacctgaaagcgtccaggtgagagtcaggaaagccatgaaggtgcaactggcatactgatgtc

SEQ ID NO: 31903 - DNA, 201 bp, Homo sapiens
ggacttacagttctgcacggctggggaggcctcagaatcatggcaggaggtgaaaggcacttcttacacggcagcggcaagagaaaatgaggaagaagcgmacgtgagaacccctggtaaacccatcagatcttgtgacacttattcactatcacgaggatagcgcaggaaagaccggcccacatgattgagttacctcgc

SEQ ID NO: 31904 - DNA, 201 bp, Homo sapiens
atttatgtagatacaaaaatagagtttgatattaaacaatactccaagacagccatttctgcagagttaaaaaatacgtaggttcagttccttaccaacaygtagacatgttgtgatgaaagaaggaaaggaaggaaggaaggaggaagggaagaaggagggagggagggaaagagagagagagaaaaggaagagaaagga

SEQ ID NO: 31905 - DNA, 201 bp, Homo sapiens
tttaggtggaggatctggtcaaggctttgtgaatcaggggatgctccacacctttctgctctctgcaacagggccagggatctgagtcccttcttgtctayccagaaaccgtatacccagtgttctctttctctcacctccgaataggtgggccttcccaatttacctgtgagaaaactagtgtgccacctcaagcgattc

SEQ ID NO: 31906 - DNA, 201 bp, Homo sapiens; identical to SEQ ID NO: 14870

SEQ ID NO: 31907 - DNA, 201 bp, Homo sapiens
agttttgaggttgaccttcagaacggcttcctgaataatacagaagtgaccctccaggaaggcccttccactgaagctacaactggagctaagcagatggrtaagccaaaaccacctccgttgctgtggccccatctccaccacaaggaagctggagaagggaccccagaaccggaagacaaaaaacttccttcacacact

SEQ ID NO: 31908 - DNA, 201 bp, Homo sapiens
aatgttaaggctagagtagaatgacatcatgggaaggcttattgaaacttggagtggattcgtagtctgccacgagaatccttgtctgatgtttgtgggtstgtaggactgaatttgaagtccttaaatggatgtcctaacagtgaataaagacgtggggcttgaatttatgtattatcttattactctgtcattttcttg

SEQ ID NO: 31909 - DNA, 201 bp, Homo sapiens
tatacgtatatatgcgtatatatatacgtatatatacgtatatatgcgtatatatatacgtatatatacgtatatatatatgtgtgtatatatatatatawaaatatatttaaataatgttaaggctagagtagaatgacatcatgggaaggcttattgaaacttggagtggattcgtagtctgccacgagaatccttgtc

SEQ ID NO: 31910 - DNA, 201 bp, Homo sapiens
atatagatggactgtgaagatgaagaaaggttctggttatgaactcacagaggaagtgacggctgaactttgtaaggacacaagtggtttaacaagtttcytggcccatatgagatctcggctccgacgttacaggcagcagtgtggggcctcaccttaccttttcccacttccatccttctccacccccgttcagttccc

SEQ ID NO: 31911 - DNA, 201 bp, Homo sapiens
cactcccaactcagcaacctgggtgtttcagccagggcttttccaggccttaatttctctgacacaggaggatggaattacattatttccaccacaaagaytgtgttttaaatccttcttagtttgcagcttttcttcccttttgcctcctctttagttcattccaatgataaatcctccctcctttgtcacagagccact

SEQ ID NO: 31912 - DNA, 201 bp, Homo sapiens
tagatgccttaaagatatgctatccacaggagcagagagcacagcaggctggatgccaaggagaattcgaccagggtaaggcttacaggcaatccattcastgcagagtcttcccccatccacacatataactccctttagtattgatgacctttctctcctgaaatattacagaaactgccctgaacgaagatagatggt

SEQ ID NO: 31913 - DNA, 201 bp, Homo sapiens
tctcccaggtactccagagctcttgacaataaatgagaacaatatagaggcagggggcacttttcatctcaggccagttccaggactctgtgtaaactgtwctaagccgaaacgtattcctttgtcccttttgccgctgtcctcctaatccacatctgggcagtgtgcactgtggctgggagttgacacagatccttgtct

SEQ ID NO: 31914 - DNA, 201 bp, Homo sapiens
tcttgaagtcctgaccttaagtgatccaccctcctcggcctcccaaagtgctcggattacaggcatgaaccactgcgcctgactgtacttttttttttttwaagtatacccatacccattgtacacatttggtattttttctttaaaaaaaaaaagcatttactttttgcctcatgaatctctgagtacattttgtgcatt

SEQ ID NO: 31915 - DNA, 201 bp, Homo sapiens; identical to SEQ ID NO: 8665

SEQ ID NO: 31916 - DNA, 201 bp, Homo sapiens
tggagctgagtctttcatcaaaaacaaggactcctggcagatgcccagaggcatttataagcagtcccatcacgaacaaattgccaaatgcaaggcctgarcaaaagacacagaaaggatttctttatcgtaagcacacttctctacattacctttataatccaacaactctgctattagtaaattatagaaacaactttt

SEQ ID NO: 31917 - DNA, 201 bp, Homo sapiens
gtgtgcagaagggcttttggataaaaggggtctagttaagagatgttaaaaaaacaaacttgaaaagcatagcaggctgccaggacatgtctgagtaccgygcagatagtggggaatagtctatggattctgcttacaccatggacaaccaggctgggccatgggttgtgttttttttcctctcattttatagaaatgtta

SEQ ID NO: 31918 - DNA, 201 bp, Homo sapiens
aatacaaatataatagaaataattatgtttgtttaaaatatacacagaaccaaatagtcatagagtagtatttcaggtggggggccctcctctagggcagwggagacaatgtcacctgtcgggaacatttggcaatgtctggagacattgttggttgtggtgcggtgacataactattggcatcgagtggatggagggcag

SEQ ID NO: 31919 - DNA, 201 bp, Homo sapiens
aagccatacgtcaccattggaaggttgccaaactgtgctttgcacacacatgctgtctgcacgccttgtatttttctctttgcttagtcctgctcatgctstctaaacaccccagacatcatatctctttaagaaactctggctgagtcccataatgttctggggcaacttctgtcttcccttttccctctggcaaagaat

SEQ ID NO: 31920 - DNA, 201 bp, Homo sapiens
attcatcatgaaaatacagctctcaaggcggaagtgcttgttaactttgcactctatagccaagtgcgatgatcagaaaatacatacattgaagacaccasaaaatagtgtatggattggtgattttgactaagactggaatgtgggtgtgtgcactcctcatgttccggtttctgtgatcattcaggcatgcacaggtat

SEQ ID NO: 31921 - DNA, 201 bp, Homo sapiens
ggatggtcttgatctcctgacctcatgatccacccgcctcggcctcccaaagtgctgggattacaggcgtgagctaccatgcctggccctgatgtcacttyttaggctaatttctgtgaaattgtgattgggaggaaaaagtgaacaggaacttaaagccagcagaggaaagctacctgcccttcactggtggtcagtgca

SEQ ID NO: 31922 - DNA, 201 bp, Homo sapiens; identical to SEQ ID NO: 4867

SEQ ID NO: 31923 - DNA, 201 bp, Homo sapiens
gctcctgttgtacactgtcccttcaataaaagttgctaacaccaccaccttgcccttgaattctttcctgggcaaagccaagaaccctgttggcctaagcygcagttctggggttcgcctgccctgcatcaccagcacagtggaaggccacaagctcacagcattttcatccgtaaacaaagcttggcaatatctctgatg

SEQ ID NO: 31924 - DNA, 201 bp, Homo sapiens
aacccatcacccaaattagtaaacatagtactcaataggtagtttttcaatccttttctccttccctccctagtccccccttttgaagtccccagagtctrttgttcctgtcttcatgcccatgtgtacgcagtgttgagcttcgacttgtaagtaagaacatgcggtatttggttttctgtttctgcatttattcgctca

SEQ ID NO: 31925 - DNA, 201 bp, Homo sapiens
cattcttcacgtctcagatatataaagcttatttcaaaataaattctggggagcgttcaacctgattgaatctgctgtaagctctgttaatatatttgttygagtcacttgcactcaaaaggtttttagacagaatatcacttttttatattattcatggtaatgtaattcccccctttaatctcttcagggtttcccatt

SEQ ID NO: 31926 - DNA, 201 bp, Homo sapiens
ctccctctccgttaaaatgcaacttaattggtaaagtttagttgactagagatttcatttatttatttatttatttatttatttatttatttgtttgtttrtttgtttgagatgagtcttgctcttttgcccaagctggagtgcagtggcatgatctcggctcactgcagcctctgcctcccgtgtccaagtgattcttct

SEQ ID NO: 31927 - DNA, 201 bp, Homo sapiens
ctgagaaatataaaaaaaaaaaaagcccacattttaaagggaatttggtatttttaacaaagcatcagggggccgggagcagtagctcacgcctgtaatgmcagcactttgggaggccgaggcgggcggatcacaagatcgggagatcgagaccattctggctaacatggtgaaatgctgtctctactaaaaatacaaaaa

SEQ ID NO: 31928 - DNA, 201 bp, Homo sapiens
gctgcatcttctaagataatggtttttcatggagactggcattgtcccgtccctatgagggggacatttgggaatggcatttttagtactcacaaggtaastggggcactcttggtcttggggaggggaggtggctggggacgcagagggtcctgcggtgggtggatacttacaacatagaaatgtcctggctcttgatgc

SEQ ID NO: 31929 - DNA, 201 bp, Homo sapiens
gccaccaccgccaaccccaccttttttttttccacataagctttcatttctggtaaatacatccttgccagagttcccaggtccaagccggtcctttgtgraccagtatgcagatttgaagttgagcactgtcacttgcctcttaggagtgttttgtgcaaccacatatttgtgttggcagataacagtagaaagaatatc

SEQ ID NO: 31930 - DNA, 201 bp, Homo sapiens
tggaaatgtagacacccaaacacccttcatggattcccagctgctgagagtttgaatagtatgtgaagtctgtagagacaaaattgttgttttccccagtygtaaagtgtgcaatattatccttgcaaaattgtctgtttattttttttgcccttttgggggacaaaatgtctttatgttaaattgttttattattgttat

SEQ ID NO: 31931 - DNA, 201 bp, Homo sapiens
tttttttccttaaaaaaatttcttttaatgcaacagatttaagggaccagggtgttctctagagcaggggtccatgacctctaggccacaaaccaatagcrgagccgtggcctgttataaattgggtggcatggcagggagtgagtggtgggcaagcataggaagctgcgtctgtgcttagagccgctctctgtcactctc

SEQ ID NO: 31932 - DNA, 201 bp, Homo sapiens
ttatagtttcctaagtatttgtattgcagcattgctttcagtggccaacaaaacaaaacaaaacaaaattggaaacaacataaaataatattaccggagawacaatgagtaacatgtataggattttttttttttttttttgacggagtcttgctctgttgcccaggctccagtgcagtggcgtgatgttggctcactgca

SEQ ID NO: 31933 - DNA, 201 bp, Homo sapiens
cctacttgaaagtgtcatataaattctgaggtgaagtggaggcattatggatgcattttattttgttttattttatttcatttattctttttttgaagagstatgggtcaagcagatctgcagcccacactcggctcactgatcacgtcccatacaatcttggcagatacttagctgaattccatcgatttagtgataaaa

SEQ ID NO: 31934 - DNA, 201 bp, Homo sapiens; identical to SEQ ID NO: 8666

SEQ ID NO: 31935 - DNA, 201 bp, Homo sapiens
gagcatgaccctgggggcctctggaacagctgctcacacactccctttaggaggcccaggctctcaggggaggcccatagtgcagctaggagctagagttktaggatgaagaaattacaggtaagaacacagccccattttaagaaataccagtgatttctgtttttccttgttcttctttccctcagtattttattaaca

SEQ ID NO: 31936 - DNA, 201 bp, Homo sapiens
gcctcctagattcaagcgattgtcctgcctcagccttctgagtagctgggattacaggcgcccgccaccacacccagctaatttttgtatttttagtatakacggggtttcaccatgttggccaggctggtctcgaactcttgacctcaggtgatctgccctccttggcctcccaaagtgctgggattataggcgtgagcc

SEQ ID NO: 31937 - DNA, 201 bp, Homo sapiens
gggcagccacatagacaacatctaaatttttgttgctttcctgggtcttgccctgtccttactgtttcccttgggcacgctgttcaccccttaggacatastacagtaaccttttcccaccaccgtgggaggactgtgattttgtaaatgtcctctgatctctcctctttgcaggcgcagtgacatttatgcacactggct

SEQ ID NO: 31938 - DNA, 201 bp, Homo sapiens
tttatagaaaaatataaatcaatactttcatgtctgtttgacgtgtttgggagctacagcaattgaggcttgccagtgtctggatgccccaccactaccamgccacttagctcagagtttgtttttttccttccaccatgtgaaatgttgctggttaaccagttaaaacggggagatggccatgattgcttttagattgcc

SEQ ID NO: 31939 - DNA, 201 bp, Homo sapiens
tcggaaagtaactcctgtccattgttccttgtgccatctttcttaagaaaacatgaggaggagcagggtgatgctagatggaagcaggagagcctggggtsttagtttcagtggctctgacttcagttttctcacctcgaaatctcccttctctgaacctttttgcgtgctcttctgtctgtctgatattcatcatctgac

SEQ ID NO: 31940 - DNA, 201 bp, Homo sapiens; identical to SEQ ID NO: 14871

SEQ ID NO: 31941 - DNA, 201 bp, Homo sapiens
acaaaaattagctgggcatagtgttgtgtgcctgtaggcctagttacttgggaggctgaggcgggagaatcgcttgaacccaggaggcggaggttgcagtsagccgagattataccactgcactccagcctggtgacagagtgagactccatcttaaaaaaaaaaaaaagtcttatattgattaaaagagacttaagacac

SEQ ID NO: 31942 - DNA, 201 bp, Homo sapiens
tctttcaatggaatatatttgacttcagggagaactcactcaaatgctgctgttactgtttttccctttgttggaagtgatggggttgtacttggaatgamtggcctagaaaaccctacaggtaccatttaagctccatagttcttctgtgtgtgtttcggatcccaggttccaaacctgcactaaaacttgttgctgcat

SEQ ID NO: 31943 - DNA, 201 bp, Homo sapiens
ttagtggcatgagaacagactaatacagtcagggatgctgcagaacatctccaaacacacaggactcccaccctctacttccaccccaccaacaaagaatsattcagcccaaaatggcagtagtgaccttgttgagaaatgctgttcaagccatacgtcaccattggaaggttgccaaactgtgctttgcacacacatgct

SEQ ID NO: 31944 - DNA, 201 bp, Homo sapiens
tttcattcccagacctctctccaaaagaggcagccatcattaaaagtttgttatggattcttccagaaacgttctatgcatttagcatcagttgcagatayggatagccttttcaaaaaatgcatgcaactgagactattggctatgttttgtttattacctactttttccatttaatagtatcttggagattatttggta

SEQ ID NO: 31945 - DNA, 201 bp, Homo sapiens
gaacatagacccagaactgccatcttttctaatttttttaaaaattagaggctaaaagttttggcttataaaaatggtatttcctgagtttttacaattayagtattaagatattcctaggtttttgtttgttttcgagacgaagtttcgctctcatttcccaggatggagtgcagtggtgcaatctcctccgcctcccag

SEQ ID NO: 31946 - DNA, 201 bp, Homo sapiens
ttctgtcatatgggtttaccatacttttctcaatccacaatctcatcagagtcccaatagttgcctgatatgtctccatcagttgtgaggtatgtttcaartgatttattactagaaattcttagcgagctgaagtttgtaaattttctcaagctactttattgatatataacacagatacataaactttgcccattcaaa

SEQ ID NO: 31947 - DNA, 201 bp, Homo sapiens
ctgtgactctatcgtgtgaattagcagagcttggctattattcccctacttcggtagatactggctgtacagaagggaaccccagtttcaatgagtacctrtgtgctgggcacttagctggtttttacacacatacttcatttgaagggaaggaattgactgaaaagaattctccattccaacttcccaagtcagttgcca

SEQ ID NO: 31948 - DNA, 201 bp, Homo sapiens
acaagataatacaaatataatagtatgaataaatatgctaatttgatagaaaatattttaatatttactactagtgtagttggacgtgttaaatattgcartggttatttgtaatctacctttataaaatttctaatgtctgccactgtttctgttagactcttaagaagatacgtgtttgtctcatagatttgtaagaac

SEQ ID NO: 31949 - DNA, 201 bp, Homo sapiens
ggtatggggtatgaatcacacatattaattttaatttcctgctttttcaattaaattgagaaagtttgggaacctctggcttaatcattatttatccactyctctgttgttggatgttagattgcttctagttcatatgtaattttataattttagttgacatgtcattatggattcttgggcataaacgtttatatgaat

SEQ ID NO: 31950 - DNA, 201 bp, Homo sapiens
gcaatcttccttctccatccccagcagcacctctgacccccttcacctgctttatttttctccatattatcattgccatcaatccaagcacaatttccagytacttacccattttgctttctccccgctctttgagaatgctggctccaacagggcaggtatttcacctgttttgtttatgcctgcatccccatcactagg

SEQ ID NO: 31951 - DNA, 201 bp, Homo sapiens
tagctaatgagaagcaaacgcatcataatgacctgggacatatgacactgaagcctactctctttccacaaagcttgatgtactcagatagtaattagtamacattttcataaataatcttaaccttttcaagcatttttgtcgattggattgtagcactcaaaagtaaggtctgttttactaatataaaattgggcctgt

SEQ ID NO: 31952 - DNA, 201 bp, Homo sapiens; identical to SEQ ID NO: 8667

SEQ ID NO: 31953 - DNA, 201 bp, Homo sapiens
aactctggagacagaggttggcgtgagctgagatcgcaccactgcactccggcctgggtgacagagcaagactctgcctcaaaaaaaaaaaaaaaaaaagraaaaaaaaagattgaacatgtggaatatgagacaaatgaaaaagattgaattccgttccaactgggcttttgaatttattttcgcacttcctattttttg

SEQ ID NO: 31954 - DNA, 201 bp, Homo sapiens
aaatgatgctcttggttccttgtctgtctttttgcccatccaacccacccttcacacatggccgagttatgccaaactttgcaagaggtgccaggtgggcrcaaagaaaagaggactgcactcaaggaacttagtctttgaggccaagcacggtggctcatgtctgtaatcctagcactttgggaggctgacacaggcaga

SEQ ID NO: 31955 - DNA, 201 bp, Homo sapiens
aggagtttgaggctgtagtgagccctggtctcaccactacacttcatcctgggcaacagagtgagatgctgttttgtttttgtttttttttgtttgtttgkttggttttttttggaaaaagaaagaatcaccataaaaaagatgggtaactcggaaatttcaaatgcttgaatttcttgggttgggaagaatatcccaaaa

SEQ ID NO: 31956 - DNA, 201 bp, Homo sapiens
tgccgcgttgggttaaccatggtagcattttaccatgagaagccatagcaagatgtgccaggtgcatgctgctggaacacctggctgaggctccaacagcrttttcctatgactgagggtagggtaggtagatgactcattacaatttataaaatggggggcttagcttgggtatcatcgtggttattccaagcagtcttc

SEQ ID NO: 31957 - DNA, 201 bp, Homo sapiens
gagttataaaaatgtttgtagtatagcacagaatgaaaaacacagcaaggtatgtacggtttaaagtgtaatcaattttgaggttgtatacaaggatatamatgataaatacaagtagtagcatttttagtaaaggctgttacaaaatactgtatttatggcctattccattctttttatagctcattaatgtagaaaaca

SEQ ID NO: 31958 - DNA, 201 bp, Homo sapiens
ataaagttattaaaaaattaatgttcccttcccatgatttttctgcagaatttatgcatccatgatactgcagaagttcataaataatggcttgtattgcygctttagtattgctttatgcctacgaaatataatgttaatttgtagcaatgctaatgtgttttcaggaaggctctttgtttattgcctttattttcccca

SEQ ID NO: 31959 - DNA, 201 bp, Homo sapiens
agatggcattttcctggttgcccctccactgagagttggctgaaacaaagaatttgtcctgtatggaaaacaggagactttgtacagtggcctctctaaakgtgcaagatattcaaaagagaaacccgcatacatttggatattaagaaataattctggggattcttccactcctgaaatgagttgatttgcagataattc

SEQ ID NO: 31960 - DNA, 201 bp, Homo sapiens
taggtagctaacaattgaattgactatgtcaggtagacttatttttcgagttgtgctggttaactgcaatccaagtttaggaagcaaactaccaatttcayttaatagaatgagctaaccaaggcacatggtgactactgtccctcaagaccgctgaactaccacttccagcacctgctcagattattcattacaatgaag

SEQ ID NO: 31961 - DNA, 201 bp, Homo sapiens; identical to SEQ ID NO: 8668

SEQ ID NO: 31962 - DNA, 201 bp, Homo sapiens; identical to SEQ ID NO: 8669

SEQ ID NO: 31963 - DNA, 201 bp, Homo sapiens; identical to SEQ ID NO: 14872

SEQ ID NO: 31964 - DNA, 201 bp, Homo sapiens; identical to SEQ ID NO: 14873

SEQ ID NO: 31965 - DNA, 201 bp, Homo sapiens
ctacctatctatgatcacatagacatttggaagcaaagagaaatgcttttcatgtgggaaaaaccaataccaacttcagtgatattatttctccgcccccygcaccgggctcttgggaatatctcttagccctcaattgtcacattcattcagcagatgttagcacgtgcaggcaccattctaggtgttggggatacatcc

SEQ ID NO: 31966 - DNA, 201 bp, Homo sapiens
tttaaacttcatggtgagcagaacactgtactccagactgtgaggccccacctgtgcagcctgctggcttctcataccagcttccttctcaccttaacccmacgtattgttgcaacggcaaaaaagagaattgcacagaggaacaccacctatcagagttcacactgagtttgcagattcatccttttgcttccagccatc

SEQ ID NO: 31967 - DNA, 201 bp, Homo sapiens
ggctcttgatgctggctacaccctcagtaagagatactgtcctagggtcatttttttcaacccacactagttacgtggactgtcttagtcagtccaggctrctataacagaataccgttgactgggtggcttgatttttttttttttctcccagttctggaggctggaagtcagatatcagggcaccagcatggttggttt

SEQ ID NO: 31968 - DNA, 201 bp, Homo sapiens
aaatggatttagaaatggtacagtcagaggttaggggtcgggtcaaagcgatccccccagagacctgtggaaagtgtggttctgtctacaagctgcgaccrtggtctttactgcttctgcaaatacttgacaaaaagggccacactcttagctggacttttcctccctttcctgaaacaatgcccttcccattgtcaaggc

SEQ ID NO: 31969 - DNA, 201 bp, Homo sapiens
tataattgaatcttgaagctagagtttcttggctatcctatttcccttttgtttccaccatgaagaagtggagagccgtgtgacgtcagtggtagagctgrtgtagaagcgccctctctgttcctggcagtgcctgtcctgctaacctcgtgtctcttgctggggtcttcatcagtaagagacctcacaagatgctttatc

SEQ ID NO: 31970 - DNA, 201 bp, Homo sapiens
caaagaggatttgagattgtttatgtaggggcccgtgtataatacctcaagagaaaaagacacagatgaggctattgggattaagggaaaatcaagtaaaycgagaggtaaagcactgtgcagaaatattggccagaagctatgaacagttgccacagctgggctgaagagttacctgtgagccttccaggggtgtaagcc

SEQ ID NO: 31971 - DNA, 201 bp, Homo sapiens
ttatcatttgctaatagagatctttgaaagaaaattcaaagattgaagtttgtattctcctaaactcctgcaaagaagtcctgtgcaaggatcgttcactmgtgttctgcatcgttcttcttactcaactctcccgagaggcattgtggacgcctgtggggttggtttttggcacccatccctgaccccttcttctccagg

SEQ ID NO: 31972 - DNA, 201 bp, Homo sapiens
attaacaacttgagtaatttatcaagttcagattctttttttcctccagaaatgctgcttttggtacactgagaggtcattcatttaaagtttgtccttgscaattccttattgaatagattccattttattttatttacattttgtacaaagctgataaataactgaaaccaaattagctcaaactggttatatttctgg

SEQ ID NO: 31973 - DNA, 201 bp, Homo sapiens
aaaaaaaaaaaaacaaacaaacaaaaaaaaaaaactccttcttcatttgttatagttccaggatagagtgtgtacctgtatagagagagtcaggcagatayaggtgtgccctccttccaagatgtgtgatggtgggcaactttctttgcatctctgagcctctattttctctatataaaatgagagagaaaaaaataattc

SEQ ID NO: 31974 - DNA, 201 bp, Homo sapiens
gagaggctgtggaaacaatagagagaatagcatggaaggccacgttgcaattaaacaagattgggaaagaagacgggactaaaatcatgccttgaagatgyttatcatatgaagttgaccttgagaccccaagaccggcttcagttttccacaatgcggctattatgagaaaaacagtgactaactgagcactgtgcataa

SEQ ID NO: 31975 - DNA, 201 bp, Homo sapiens
atttgtgagcaaactctcagtgtgggcaggtgacaatttctgcaggtattttccccccattttaacttgtgcgatatagttccctattttgttttgttccrcctcgatcacaacagctgccacccgaggtttaaagatactgttgtcctcatcttcagaacaagggttacgtttgctgtatctggagaaagtccatagttt

SEQ ID NO: 31976 - DNA, 201 bp, Homo sapiens; identical to SEQ ID NO: 8670

SEQ ID NO: 31977 - DNA, 201 bp, Homo sapiens
gcctcccaaggccaagcccgccagccacacacacctttgtgagaattaagaaaagatgccccctcctcttggggcccacagctcctccacctgggcacccrgcctggtgaacagggtgcaggctgggatttagccctaccttgcttttggaccattgagctactaagttggagcaacaaggcttgggaatttttctttgat

SEQ ID NO: 31978 - DNA, 201 bp, Homo sapiens
ccaaagggaagaaaatagtgcggaatcttttctccaggtttcaggacccatgtctgttgtccttcctttaccttaacttcagcagggcaagaatggttcargccacattagaaagcagttactttctcacccaattttaaaggagaaaggtagatgcggtgggttctagggatttcagtgacgtaacaggtgtttcccagg

SEQ ID NO: 31979 - DNA, 201 bp, Homo sapiens
aaaccacacatggcctgctcacaaatcttatgataaaactctacccactgagaagcacaaggtgtgaggctattgatgaggagttgaaggtgacagagacygagaaagggctgcacacctttggcctaaagggtaatgagcaacacacaaggattgggagatgttcatggcaagaaaaattcagaagggacattgttgttt

SEQ ID NO: 31980 - DNA, 201 bp, Homo sapiens
ggcctattttttcctccttcttctccgtcttaagtcctgaaatgttttagtgacccagaatgaagcttatttttttaatcatacttccataaaatgtaacycctgggacttggaagagagagaccagccaagggttagcttgaaccctttatcactcccaaacacaggggcttatggtataagtgacacactgcagataga

SEQ ID NO: 31981 - DNA, 201 bp, Homo sapiens
acaggttgagggttcaagctgtccaatccctgctcatctgcagcacaccaaggaatgtggactaatgaaaaataaactgcatgcatgcagtgcccatcacrctgcctgcattttctaatcttcacaataactctgtgttgagaaatattcctgtctgtaatcccggcactttgggaggctgaagcgggcagatcacctgag

SEQ ID NO: 31982 - DNA, 201 bp, Homo sapiens
accactatgccatgtagcatatcaagattatttttctttcctgcaccttattttttccctggagttaatactcatctttttttagaaatttgctgagtttktgatgtacctatcattcaacctcaaactttcatgtgattgtctaaatctcagttccttttattagaaaaaaaaaaaaaaacaactcccctggagcctttg

SEQ ID NO: 31983 - DNA, 201 bp, Homo sapiens
tatatatacacacacacatatatatatacacacacatatatatacacatatatacacatatatatacacacatatatatatacacacacacatatatatayacacacatatatatacacacacatatatatatatacatatacacacacacacacacacacacacacacacacacatatattttttttttcttttagatgg

SEQ ID NO: 31984 - DNA, 201 bp, Homo sapiens
gctacatacatttgaaaattaggatgatttgaaattgaaatgagggcttatgctgttcattggattaatttttctctcttataaataaaaaatatatacarataatacataaacattgtttttcactgtggcttgaattttctaacaatttttttcttcttctcaggaaatgttttcttcttatacctccaaaataaccac

SEQ ID NO: 31985 - DNA, 201 bp, Homo sapiens
aggttgggcacattttttaaaggtttgtgagacatattgccaaattgctctccaaaaggtttgtagcaatttaaatgatcagaagcagcactgaagtccaktttcgtctaaccagtattgagtgctcattaaaaaaaaaaaaaatcattactaatatgataaacaaacaaatggtgtgttattgttgggttgaaagaagca

SEQ ID NO: 31986 - DNA, 201 bp, Homo sapiens
ggctggactgtcacttggttgttctcggtttcaggacccacgtcttttgtctctgtaatgaatgtgttcagaggtctctgcacagagaagctggctgttargaaaactatttcttctttccgagacaggctgcaaaatgcttgttactattttgtgtattcctggcaggatttgtattcttagttttattactaatgataa

SEQ ID NO: 31987 - DNA, 201 bp, Homo sapiens
aaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaa

SEQ ID NO: 31988 - DNA, 201 bp, Homo sapiens; identical to SEQ ID NO: 8671

SEQ ID NO: 31989 - DNA, 201 bp, Homo sapiens
tcataaaatgaaactggcagtgagctcatatggaagaggcatcacgggcaactcggcttggctcaccagcccctgagctgcccccgagtgaccgctccagmcttctttccttccacctctccctcttggccaacttcatgcttcagccaaagtgaactgagctcaccaggctgagtcatctgtgccagctgtgccctctcc

SEQ ID NO: 31990 - DNA, 201 bp, Homo sapiens
taatcccctcatgcactggctttgcgaatttctttttcagcctgggtttgaaagcaaagtggtagtgactttttcctgatagctgctgaaaaggttccacrgtatttggaccgctgcctgcttctaccctggagcacaaaagatccaggcgtagaaattggttctaacaatatccttttagagaacaccaaggggatgtga

SEQ ID NO: 31991 - DNA, 201 bp, Homo sapiens
tctcattaatgtctgggcaaaactcaaagaggcaaacattttcattacatactgttatccatcctattgtgggaccaatttctccagaaaggtctctctcrgtgggaggattaataaacaccatcagaaatccaattaaacccaattgttaaaatccaacaaatacgttgcttgtggatacagttgtgtatagtaatgtgt

SEQ ID NO: 31992 - DNA, 201 bp, Homo sapiens; identical to SEQ ID NO: 8672

SEQ ID NO: 31993 - DNA, 201 bp, Homo sapiens
taataataataataataataataataataataataataaagaaagcgagagaggaggtagggaatgaatgccgaaagtggttccttgggtctgatgcccaygcttaaccgattcccagccaaacatttcacagttgtcttacgcacaggcgtaagatatgcatctatcttggtgtgcacctgagaagtagttatgtctaag

SEQ ID NO: 31994 - DNA, 201 bp, Homo sapiens
tccctttggaagcagggataagaagagggaaggtctcccagatgtaaatttctcataaatatttgagctccatttcagtaattctttcattctctgatctsttgcctaatcttctatttagcaagtactttccatgaaatagaaggctttaattgatagaattactaatttgaatagcttagcacagctcagcttgtaaaa

SEQ ID NO: 31995 - DNA, 201 bp, Homo sapiens
aggacccttgccattaggaccaaacctcttccagctttctcagcagccacatgtcaccccctcttccaccctttgccctgccaccctccatcccctgataycctcctgccttttagttgccggtgcttggaaacctttgcaaagtctttttatggagatgccatgtcctttcaatggtgcgtttagccagcgccccgctct

SEQ ID NO: 31996 - DNA, 201 bp, Homo sapiens
aggctgcagctggttagaccagggctgtgcaaccctagagccattgccttgaccacaaagccacagtctcctagtcctaatattaagaggtaggaggtagrtagagattgtcccttaagccacattccattcttcatatttttgtacccattagagtagtgctgatcatttgccttcattgctggggtcccctaaatgcaa

SEQ ID NO: 31997 - DNA, 201 bp, Homo sapiens
tctgagggcctgtgcattagttaaaactccttatctggtcatagagggtggtgtggtttggacgcgttccccttgtctgtgcaattcccaacagaggcaastgcgcatttgagacaggttgagggttcaagctgtccaatccctgctcatctgcagcacaccaaggaatgtggactaatgaaaaataaactgcatgcatgc

SEQ ID NO: 31998 - DNA, 201 bp, Homo sapiens
acgtatatatgcgtatatatatacgtatatatgcgtatatatatacgtatatatacgtatatatgcgtatatatatacgtatatatacgtatatatatatrtgtgtatatatatatataaaaatatatttaaataatgttaaggctagagtagaatgacatcatgggaaggcttattgaaacttggagtggattcgtagtc

SEQ ID NO: 31999 - DNA, 201 bp, Homo sapiens
tttgagtttttaattttttgtagagatgaggtcttgctatgttgtccaggttggtcttgaacccctgagtccaaaagatgctgctgtcttggcctcccacygtgctgagattacaggcatgagccaccatatctggcctatgttagctatttctgaaacttcatttctgtctgtaaatggcaatcataatatatgtcacgt

SEQ ID NO: 32000 - DNA, 201 bp, Homo sapiens
attagctgggcatggtgctgtgcacctgtaatcccagctactcaggaggttgaggcacgaggatcacttaaacccaggaggaggagattgcagtgagccarttgcgccactgcactccagcctgcaatgcagagtgaaactgtcttaaaacaaacaaacaaacaaaaagcaaaaatctgaaaagacatctcaaaagccaat

SEQ ID NO: 32001 - DNA, 201 bp, Homo sapiens
gaatgtggccctgtgccggtgcccaaaccagcaggctgcacgtatgcactgacagaatggtacatcccaccactgctctgtgtctgtgtgcgactgtcagytgctctctactgctcctcatagacttcctgtctgcctttttctgcatttctcagtctccccatctccccttcttatctaatccccttccttcctctctca

SEQ ID NO: 32002 - DNA, 201 bp, Homo sapiens
ttctggagttatgaaatgatggtatcctgctgggctgagtggggagggattctcaagctgtacatagctgacacacaggtttctaaaaggttgtctttcamccccattttcagaagtaccaggttccacattttctgagcctttgctggctctctgataggaattgtgttacttctcagctgtccccatggctagcttaag

SEQ ID NO: 32003 - DNA, 201 bp, Homo sapiens
cctgatctctactctctgcaacctccacctcccaggttcaaacaattctcatgcgtcagcctcctgagtagctgtgattacaggtgtgtgctaccacggcmggctaatttttttgtattttattagagacggggttttgccatgttggccaagctgatctggaactcatgtgctcgagcaatccacccacctcggcctccc

SEQ ID NO: 32004 - DNA, 201 bp, Homo sapiens
ttgaattataggaattctatatatattttggatacattctttttttttcatatgtactgtgaattttctcctttgtcttgtctatttattccttaatggtrtcttttgaaaagcagaagttataaatactgatagtgtccaatttatctttttcatttgtttagtgctttcttgttctaagaacctttaccaatcaccagg

SEQ ID NO: 32005 - DNA, 201 bp, Homo sapiens
acatcaaacctggcttcttagtccactgctgagtcttcccaattctgaaaaaaaggattcagggtataatttctcacacagatttctgggacagtgctttyttggagcaccacgcctcactaatggaacactcatgtataattctggcttttgaatttttatttttttattaacatacacagtcagcattgggtgtggctc

SEQ ID NO: 32006 - DNA, 201 bp, Homo sapiens
aaaagttggagagtgaaatctcaagcaagccaaaaagtgatagatgagttaaaaaaaaaaaaaaaaaaaaagttgcctggcttggtgcagtggctcatgcmtgtactcccagcactttgggaggctgaggtgggcggatcatctgaggtgaggagtttgagaccacactggccaacatgttgaaacccgctctctactaaa

SEQ ID NO: 32007 - DNA, 201 bp, Homo sapiens
gttagtagaaactaatttctcttgcttttctctaaagtatacttgatttgaaatatgtgccctgaagttttgctatgttgaaaaaaatgatgagccgggcrcagtggctcacgcctgtaatcccagcactttggaaggccaaggcgggtggatcacctgaggtcaggagtttgagaccagcctgaccaacatgttgaaacc

SEQ ID NO: 32008 - DNA, 201 bp, Homo sapiens
cttcctaggctgtccaccatgacatcagcctgcccatgcaatgcttgagatttgccctgtgactcaacccaaatctaaagcccgagtcgtatgaatccagracacctgcctgcaaatgcatttttcatgtataggttattcactctggtctttgagattatgtaattagcatatgttgtcatagtgatgtatttattataa

SEQ ID NO: 32009 - DNA, 201 bp, Homo sapiens
tagatattatctgtaggtttttcaataagaaggaaatttagcttccttctactttggtgccccatgatgatgtgcatcttttttatttctgcatcatatcmatatagtgatatcatgtataatgatgtttaagaagacagttttttttgtttaaattgttataaataagtaagtgtatgcaccactatgccatgtagcata

SEQ ID NO: 32010 - DNA, 201 bp, Homo sapiens
gatccatggctccttttcggtcaccttccagccagcaacattgggctgactccttcaatggccatgtctctggttctttgtcttttgcctcctcctcttayttttaaggacccttgtcatttcattggtctcagctggatagctatcaagggtcactttaaggtcagctgactagcaaacctaattctatctgcaacctta

SEQ ID NO: 32011 - DNA, 201 bp, Homo sapiens
acctcatatactcatggtaacggcttccggcatccaatgaccttgccattgcggaggtcaatttcatgtgtgtgtgcacacatgggtgcgtatatgttacmgagggaaacttgcctgtttgaagcaggtgtcgtggaaacaacatgggctttagagccagacatggaatcctttcttatgattaatgcagctaaatttccc

SEQ ID NO: 32012 - DNA, 201 bp, Homo sapiens
agttatatcacaaccagaacacacaatgaccagcaggcttctctttttttgtttgatttcactcctgaaaagtgggctttctgtgagagttggacagactscatgctgcccctgcctcccgggccttccttcccaagcagggatgagctctcctctgcatgtaacaagcaaggtgattcagcaagaagactgctggtctct

SEQ ID NO: 32013 - DNA, 201 bp, Homo sapiens
tcccccaggctacagtgcagttgcgtgatattagctcactgcagcctcaaacttctaggctgaagtgatcctcccacctcaacgtcctgagtagggagggsactacaggcgcatgcctccacatctgactaattactaaatttttaaaaatttttttagacactgagtctcaccgtcttgccctggctggtctcaaactcc

SEQ ID NO: 32014 - DNA, 201 bp, Homo sapiens; identical to SEQ ID NO: 8673

SEQ ID NO: 32015 - DNA, 201 bp, Homo sapiens; identical to SEQ ID NO: 8674

SEQ ID NO: 32016 - DNA, 201 bp, Homo sapiens
aggttacagtgaaccgagatcgtgtcactgcactccagcctaggcgacagagcgagaccctgtctcagaaacagaaaataaaacaaacaaaaaaatactaytccatagctgactattttctgaaatgattttgttacttttctaatgagaaaaaaatagatctcgtgtgtggagggaattgaagatgtaatttcagactct

SEQ ID NO: 32017 - DNA, 201 bp, Homo sapiens
agcaattataattgaatcttgaagctagagtttcttggctatcctatttcccttttgtttccaccatgaagaagtggagagccgtgtgacgtcagtggtasagctgatgtagaagcgccctctctgttcctggcagtgcctgtcctgctaacctcgtgtctcttgctggggtcttcatcagtaagagacctcacaagatgc

SEQ ID NO: 32018 - DNA, 201 bp, Homo sapiens
acactgtcatggtgctggtgggagtgtctcttagcgtgctaatggattcatattagggtataatgagtagtaaggatgaccaaatgtcgttgccatctttsttttggtgggttttggccggcttctttactgcaacctattttatcagcaaggtctttatgacctgtatcttgtgctgacctcctatgttatcctgtaact

SEQ ID NO: 32019 - DNA, 201 bp, Homo sapiens
accctgcatctactaaaaatacaaaaattagctgggcatggtgctgtgcacctgtaatcccagctactcaggaggttgaggcacgaggatcacttaaaccsaggaggaggagattgcagtgagccaattgcgccactgcactccagcctgcaatgcagagtgaaactgtcttaaaacaaacaaacaaacaaaaagcaaaaa

SEQ ID NO: 32020 - DNA, 201 bp, Homo sapiens
agaggacagagtgggtggcacaggcattgcggaggcagaaatttacgtggcttccatgcccattggtgtgaggagtgaggggtgatcagggatcccagtgrcttgaaagtataacaaaagtatgactagatccaggaaatacagctggagagacccaagtctgcacagaaaaggtttacagagcccaggcacacagatgac

SEQ ID NO: 32021 - DNA, 201 bp, Homo sapiens
cactagaagtttcagaaagatgcagactgctttaaaaaaaaaaaaaaagggcaaggggaggtgtgagaagaaagtataattctttttcttctaactggagrtataaaaatcatataagcatgatttatgatttgattggaacattgtattttatggttgcagagcacacgtatcatcctatctgcttctgacacccagtaa

SEQ ID NO: 32022 - DNA, 201 bp, Homo sapiens
tggcctcaagtgatcctcccacctcagcctcccaaagtgctggaaataaggtatgagccaccaagcctagccttgatattattttttaatgggggtgtgtsggtgggtggtgatggggatattccagcagaatatcagaaacagagatgaggaaggcagagagagctcaaagacaaggctcaagttcatattccaacgcca

SEQ ID NO: 32023 - DNA, 201 bp, Homo sapiens
tacctcagatggctttgttaggttagattccctgaagtggaatggccagggaatttaaaaagggttttgctcttgtcacctgggctggggtgcaatggcgygatcttggctcactgcaacctccgacccccctgggttcaagcgattctcctgcctcaggctcctgagtagctgggattacaggtgcctgccactatgcct

SEQ ID NO: 32024 - DNA, 201 bp, Homo sapiens
gctgatgaggatagcagtttcttttgttcttttaaaacatatataaaattatttttatcaaacatgacagatcaaaagccttctggaaaggagagatggtractaatttaggcagtgtcttttgctttcacatggtgtacccagtactattaatatgaatttatcacatggaaacaaacttttaaaaaaattaattttgtg

SEQ ID NO: 32025 - DNA, 201 bp, Homo sapiens
gaaagacagttcaccaaatctatcgattaatagaaatcatccagcagcagtgccactgtaagatgttcaatacgtagcacctttctgtcccttctcctctwgccagttgggacaggattagcaagccaaagactttctgaaataatccttagctatattcttggtattcaccaaggaatttaccaatatgcaaagacttgg

SEQ ID NO: 32026 - DNA, 201 bp, Homo sapiens
tttatccatggattggtatgagccctaatggtgcacccttccgacaatccttcatccttcccagacgtttcatcagccaagtgaaatttgcaattgtttcwgtgattgaaattatgcttggagtgcaggtgtcatggatgaaacagcaatgccttgcggtgacaaattcagtgtagaaataattttagcaagcccagtgat

SEQ ID NO: 32027 - DNA, 201 bp, Homo sapiens
tataaaaggcagtgttttaagttctagaattaaaagcaattgcagcaaataccaagtgagattttctgtattttgagagtttgtgtgtgcaatggttttcyactgactaatcaggctgataaaacaacctgaaaatggctttcccatggagtttatatatttcgtcagagacctaaaatggtataaatgttcaataatagc

SEQ ID NO: 32028 - DNA, 201 bp, Homo sapiens
tttaagtgatgcatcagaatttcatgatgagcaaatgcctatggatgccctcatttctcatccttcttgactgtctgctaagattcactcttggtcttgtstttgagcttttctgttcagtgatgtaatgggacaggctctcctgtcatcaagagttcccatcatacctgggcactgccatttcctctgtggtagatgctt

SEQ ID NO: 32029 - DNA, 201 bp, Homo sapiens
gtttgtgcagtgggaagttggagaaagtacaaatgaaagcctctctgcagtgaacctcatgactgctttagagaggtgcttatgtaataactgcagtggtrtcgctttagaaaaagttacagagcttgtctttctagagcaacctcttggcttatcttaattaccagcagtccatagtgagactggagggaagaaaaaaag

SEQ ID NO: 32030 - DNA, 201 bp, Homo sapiens
gtggagagacagagaatcagttaattccagggtcatgtattaggtagtaagatagtggttcacaccaaaaacatagaaaatgatcacttagcctgatccasaagttcaggaaagggctctgagcaggagatggaagacctcttggctggttaaatggagatcaagtggcagcttggactcctgctgcaattaaaaaattac

SEQ ID NO: 32031 - DNA, 201 bp, Homo sapiens
ttcgttcttaaccaacatggcaccccaggttcagtggtgagagtgtcactggcaacttctgaaataacatctctgttagtttgtggagtgggctaaatggscagcccttctacgagctccctcatggttgcgggggactaccaatcactctctactttttttttttttttttaataggtcttgtcatttgtaaatgcagaa

SEQ ID NO: 32032 - DNA, 201 bp, Homo sapiens
gtgccccatagctgcaaagtcacaggaagcttgcagcaggccagtggtaacctctgagtgacttctgagttcccagagctaggaccatgacttttcccctrgattcttaagtacccggctaaaattgtgtttgccgaatgaaagtgtgatcctggaggccatgttgtttgtggttcatggaagggtgcttgttcagcttgg

SEQ ID NO: 32033 - DNA, 201 bp, Homo sapiens
catgttgtagcatgtatcagtacttctttttttagggctgagtaatattccatttacggatatgccacatttcatctatgcattcagttcacggacatgtrggttgtttccacattttggctattgtgcataatgcttccaggtacacttgtctacacatttttgtgtggatataggttttccttttttggggtatgctcc

SEQ ID NO: 32034 - DNA, 201 bp, Homo sapiens; identical to SEQ ID NO: 8675

SEQ ID NO: 32035 - DNA, 201 bp, Homo sapiens
taaagtcttcagagcctagatattcactagaacccagtggtcacgtgttcctaatgggtggaatattattttgaatctttccatgatgagagttacattgmtgggtgaaagctttttatgcaacatcatcattgttgaataaacagacgcttagcatatttaggttggaatgcaagggaactaaaggtaggggagattctt

SEQ ID NO: 32036 - DNA, 201 bp, Homo sapiens
taaaacatatataaaattatttttatcaaacatgacagatcaaaagccttctggaaaggagagatggtaactaatttaggcagtgtcttttgctttcacawggtgtacccagtactattaatatgaatttatcacatggaaacaaacttttaaaaaaattaattttgtgaattaaataaagcagcatgcaaatttactatc

SEQ ID NO: 32037 - DNA, 201 bp, Homo sapiens
tggttaattaaagcttattgtatgccatgggccattctaagaacttccatccacccaaaagcactatgaaatagatgttgttatttcactgatggaaaaasaagcacagagaggctaaggaatatgctgaagcttgcacagctagtaaatggcagaacattcagactggaattcagacttatacactcacattcataccac

SEQ ID NO: 32038 - DNA, 201 bp, Homo sapiens
atttattgtaatggtaaattacactaataataatctggggatgaaaacagggcaggcagtgaaacctgaatctcagctggacgatgaatgagttttaatgyaagtgtatcgacgtgctgtactcctaacacattatttgttatctgaaatttagatttccttgggtgtcctgcctttttttttttttttttttttttttga

SEQ ID NO: 32039 - DNA, 201 bp, Homo sapiens
ataaacagaaattagctgggcattgtggtatgtacctgtagtcccagctactcaggaggctgaggtgggaggattgcttgagcctgggaagtcaaggctgyagtgagcaaagatcacaccactgcagtcaagcctgggtgacagggcaagaccctatatcaaaaaaaaaaaaaaaaaaaaaaatatatatatatatatata

SEQ ID NO: 32040 - DNA, 201 bp, Homo sapiens
acctgagtcttgacgaagaagactgaggaaaggcccccccccccccccaccaaattgtcccgttgtctcttggctggtcttgccagctggcacacagcttyctctgaccaccctgctaggtacaaatcccacatgaaaagtctcaatcacctggctcaaactcatagttttcaggtggcataagccatggcattttcacct

SEQ ID NO: 32041 - DNA, 201 bp, Homo sapiens
gaaagcagtagagggatggagaagaagtgggtcaaaacctggtttctgcctgtgggaaaatacaaaacaacacaacagcaaagcagactagcatggttcamagcacacattgaggtttttggtgtgccattctaatgcatgagctcattttgagccaaggatagctttttggtgtagaattttgccagtcctacggtcaat

SEQ ID NO: 32042 - DNA, 201 bp, Homo sapiens
tttttagtatatacggggtttcaccatgttggccaggctggtctcgaactcttgacctcaggtgatctgccctccttggcctcccaaagtgctgggattayaggcgtgagccactgcacctggccagtagtagacttttgatagggtttttttttctcaaggtgtaggtttggctaggaagtcatagaaaatgctcttttt

SEQ ID NO: 32043 - DNA, 201 bp, Homo sapiens
cattgccacagtcagttttcttacctgaaggagaaagcctgcaccccatattttttacctcccattctccacttcaactcttccccagcctctgcgaaccsctagtctgctcttcatctccatgcgtttgtatattctggacatttctcattaatgggctcacacgatatgtggttctttgtgagtggtcctttcactttg

SEQ ID NO: 32044 - DNA, 201 bp, Homo sapiens
cgagactccatctcaaaaaaaaaaaaaaaaaaaaaaggctgtgtgtggtgactcgtgtctattgtcccagctacttgggaggctgagacatgaaaatcacwtgaacctgggaggtggaggttgcagtgagctgacatcgcatcactgcactccagcctgggtgacagagtgagactgaaaaacaaaaaaacaaaaaaaaac

SEQ ID NO: 32045 - DNA, 201 bp, Homo sapiens
ggagaccaaggaaatgaccagcacgtggctcactccctgtctgtccagtagaggacaccaaggcacgatgaccgcagctcctgtagtagttatggtcactsactccgggttcagacggacttggggttcagtcctagctctggcgcttaccagttttctcaagtgactttgagcatctttactcaaggctcttggtctcag

SEQ ID NO: 32046 - DNA, 201 bp, Homo sapiens
gcaggccatacaggaagcccagttagggaggcgtaaggaaacttaaaatcatggcagaagatgaaagggaaacaggcatgttctgcatggctggagtaggmggcaaggagcgaaggaggaggtactacccacttttaaacaaccagatctggtgagaactcactcactgtcatgagaacagcaagggggaaatcagccctc

SEQ ID NO: 32047 - DNA, 201 bp, Homo sapiens
caacacgtaggttcttagttttttaaatatatatatatatacgtatatatatacgtatatatatgcgtatatatatacgtatatatgcgtatatatatacrtatatatgcgtatatatatacgtatatatacgtatatatgcgtatatatatacgtatatatacgtatatatatatgtgtgtatatatatatataaaaata

SEQ ID NO: 32048 - DNA, 201 bp, Homo sapiens
gcaacacgtaggttcttagttttttaaatatatatatatatacgtatatatatacgtatatatatgcgtatatatatacgtatatatgcgtatatatataygtatatatgcgtatatatatacgtatatatacgtatatatgcgtatatatatacgtatatatacgtatatatatatgtgtgtatatatatatataaaaat

SEQ ID NO: 32049 - DNA, 201 bp, Homo sapiens
tttgtagcttgattctatttataatgtactcacaccttaaccaatagcctcacagatggcatatgagaatactcatactcagtgctgctaaaaacagcctrctgcctgaacaccagagtgtcttttaaagcgtagaaaagttgggtacataaaatttctgttgcaaaaaggaatgtataggccttaattgaaaatgtatct

SEQ ID NO: 32050 - DNA, 201 bp, Homo sapiens
gttttatgtttgatggttttttctttttctttcttttttttttttttgagacagggccttgctttgtcaccctggctcaagtgcagtggtagaatcatagstcactgcagcctcaaactctttggctccagtgatcctcccacctcaacctcccaagtagctgggactacaggcgtgtaccaccatgaccagctaatcttt

SEQ ID NO: 32051 - DNA, 201 bp, Homo sapiens
atttttatttaaaaatttttttaaagagtgatctttggttttctcagtagatgctttcctctgaatagcaagcatatagatagtcttctccttcagacccmcgaccatggctatattatttagtctacagtggttctttgtacaaagtgcttctgcaaagctcttagagcacccagagctggctttggaaagcaagacatt

SEQ ID NO: 32052 - DNA, 201 bp, Homo sapiens
aaatcacagcccatctcctccaatcatttggggtattaggattcccttcactccaactcccactggaaaacctctttgccatgacacagagattccacaaycttctatttttatttaaaaatttttttaaagagtgatctttggttttctcagtagatgctttcctctgaatagcaagcatatagatagtcttctccttca

SEQ ID NO: 32053 - DNA, 201 bp, Homo sapiens
accataatctgctataaattcagttgaaaaatagaaatagtgagaaatccaggttgtgctctgtcgtaatttaagcctaatatgtgattgtctacatgttyacaagttaccgcctttttatttcttctctttttctgttttcttcttccatttttatgttttgctatgccattcattcattctattcttttcatttctttt

SEQ ID NO: 32054 - DNA, 201 bp, Homo sapiens
gagttagagataggaaaataccataatctgctataaattcagttgaaaaatagaaatagtgagaaatccaggttgtgctctgtcgtaatttaagcctaatrtgtgattgtctacatgtttacaagttaccgcctttttatttcttctctttttctgttttcttcttccatttttatgttttgctatgccattcattcattc

SEQ ID NO: 32055 - DNA, 201 bp, Homo sapiens
ctaaaatgccagcatcactgttacttactgtgtttctctggatgtattacttaacctctctggctttatttctgcccgccctccccccgcccccccccccsaatgcctcaatctgtggcagagttgttacattattgaaaaagaacataaagcatattttctggcatacagcatatgtttaatttataatttttgttttta

SEQ ID NO: 32056 - DNA, 201 bp, Homo sapiens
gggcctagtaaaggaatgtaaatactaaaatgccagcatcactgttacttactgtgtttctctggatgtattacttaacctctctggctttatttctgccygccctccccccgccccccccccccaatgcctcaatctgtggcagagttgttacattattgaaaaagaacataaagcatattttctggcatacagcatatg

SEQ ID NO: 32057 - DNA, 201 bp, Homo sapiens
gcatattctgtctttttatattctgccacccctatcatacttatgaaaatgccaggttgtaatcattcactgggagaaacaaggggttgaacattgttatygcacaaaggaagctgggcctagtaaaggaatgtaaatactaaaatgccagcatcactgttacttactgtgtttctctggatgtattacttaacctctctg

SEQ ID NO: 32058 - DNA, 201 bp, Homo sapiens
ccaatttggcatattctgtctttttatattctgccacccctatcatacttatgaaaatgccaggttgtaatcattcactgggagaaacaaggggttgaacrttgttatcgcacaaaggaagctgggcctagtaaaggaatgtaaatactaaaatgccagcatcactgttacttactgtgtttctctggatgtattacttaa

SEQ ID NO: 32059 - DNA, 201 bp, Homo sapiens
tcagttacagaaacctaaattgctaaattgcaaggctgtatatgatatgccaatttggcatattctgtctttttatattctgccacccctatcatacttakgaaaatgccaggttgtaatcattcactgggagaaacaaggggttgaacattgttatcgcacaaaggaagctgggcctagtaaaggaatgtaaatactaaa

SEQ ID NO: 32060 - DNA, 201 bp, Homo sapiens
aattgttttattattgttatctttatggagttaagggcacataaaatattcttacagagagaaattctgtagtttccacaagtaaccagagaattgttcawggcagagaattattttttcaatgcctattttctcctgaattttctgacggagttagagataggaaaataccataatctgctataaattcagttgaaaaat

SEQ ID NO: 32061 - DNA, 201 bp, Homo sapiens
agatgcctccagcaattataattgaatcttgaagctagagtttcttggctatcctatttcccttttgtttccaccatgaagaagtggagagccgtgtgacstcagtggtagagctgatgtagaagcgccctctctgttcctggcagtgcctgtcctgctaacctcgtgtctcttgctggggtcttcatcagtaagagacct

SEQ ID NO: 32062 - DNA, 201 bp, Homo sapiens
tcctgacctcacgtgatccacccgccttggcctcctaaagggttgggattacaggtgtcagctagtgcacctgaccctaggataatcttaattttaagtarctggtaactcataaatttttaaacactctgcagttcaaagaaaacatgtttgtggtaggtagccagtttataacctgtgtaagactgtgttattagcaaa

SEQ ID NO: 32063 - DNA, 201 bp, Homo sapiens
aaaattagaggctaaaagttttggcttataaaaatggtatttcctgagtttttacaattatagtattaagatattcctaggtttttgtttgttttcgagasgaagtttcgctctcatttcccaggatggagtgcagtggtgcaatctcctccgcctcccagtttaagccattctcctgcctcagcctcctgagtagctggg

SEQ ID NO: 32064 - DNA, 201 bp, Homo sapiens
ggagtgttgaggacctgtcaaacaacacagtccccatctgtactttgggagggaaggacttcttaattccagctgcctgttgccatgggggaacatagacscagaactgccatcttttctaatttttttaaaaattagaggctaaaagttttggcttataaaaatggtatttcctgagtttttacaattatagtattaaga

SEQ ID NO: 32065 - DNA, 201 bp, Homo sapiens
aggcagatgttgcagtgagccgagatcaggccactgcactccaacctgggtgacagagccagagtctgtctcaaaaaacgaaaaacaaaaaaaaccaaaaractaaatgtataaaaggtacccaggtgatgttgatgctacttgtcttggccaatgaaatgaaaagcctacaggccaggcatggtggctcatgcctgtgat

SEQ ID NO: 32066 - DNA, 201 bp, Homo sapiens
ggctggggcaggagaatcgcttgaacctgggaggcagatgttgcagtgagccgagatcaggccactgcactccaacctgggtgacagagccagagtctgtytcaaaaaacgaaaaacaaaaaaaaccaaaagactaaatgtataaaaggtacccaggtgatgttgatgctacttgtcttggccaatgaaatgaaaagccta

SEQ ID NO: 32067 - DNA, 201 bp, Homo sapiens
gctatttggaaggctggggcaggagaatcgcttgaacctgggaggcagatgttgcagtgagccgagatcaggccactgcactccaacctgggtgacagagycagagtctgtctcaaaaaacgaaaaacaaaaaaaaccaaaagactaaatgtataaaaggtacccaggtgatgttgatgctacttgtcttggccaatgaaa

SEQ ID NO: 32068 - DNA, 201 bp, Homo sapiens
aatttgccgggtgtagtggtgcacacctgtagtcccagctatttggaaggctggggcaggagaatcgcttgaacctgggaggcagatgttgcagtgagccragatcaggccactgcactccaacctgggtgacagagccagagtctgtctcaaaaaacgaaaaacaaaaaaaaccaaaagactaaatgtataaaaggtacc

SEQ ID NO: 32069 - DNA, 201 bp, Homo sapiens
gccaggagtttgagaccagccttgccaacatggtgaaactccatctctactaaaaatataaaaatttgccgggtgtagtggtgcacacctgtagtcccagytatttggaaggctggggcaggagaatcgcttgaacctgggaggcagatgttgcagtgagccgagatcaggccactgcactccaacctgggtgacagagcc

SEQ ID NO: 32070 - DNA, 201 bp, Homo sapiens
acaagtcttccatgtgattctgagacagactcatgttcgtgtggttctggctctgcagaactgaggtgggccccaaaacttgcgtttctaaaaggtactasctgagcatgatgactcacatttgtaatcccaccactttgtgaggccgaggcgggtggatcgcttgaggccaggagtttgagaccagccttgccaacatgg

SEQ ID NO: 32071 - DNA, 201 bp, Homo sapiens
tctgccacggtggtttgctgcagagatcaacttatcacctggatatgaagcccagcgtccattagctgttgttgctgatgctcttcccaccacctgcaagycccagtgtgtgttatccgcctccaccgtgtgtccatgtgttctcatcatgcagctcccacttataaacgagagcatgcagtgtttggttttcagtttctg

SEQ ID NO: 32072 - DNA, 201 bp, Homo sapiens
agatgtgcaagtttgttacataggtaatcatctgccacggtggtttgctgcagagatcaacttatcacctggatatgaagcccagcgtccattagctgttsttgctgatgctcttcccaccacctgcaagccccagtgtgtgttatccgcctccaccgtgtgtccatgtgttctcatcatgcagctcccacttataaacga

SEQ ID NO: 32073 - DNA, 201 bp, Homo sapiens
aaactttaagtttcagggtacatgtgtaagatgtgcaagtttgttacataggtaatcatctgccacggtggtttgctgcagagatcaacttatcacctggrtatgaagcccagcgtccattagctgttgttgctgatgctcttcccaccacctgcaagccccagtgtgtgttatccgcctccaccgtgtgtccatgtgttc

SEQ ID NO: 32074 - DNA, 201 bp, Homo sapiens
agcccctggacctgcagtgtcagcatcacctggtagcttgttagacatagaaattcttgggctttattccacacataatgaatcagaagcttatggggtgrggcctgcagtctgacgtttattttttctaaaactttaagtttcagggtacatgtgtaagatgtgcaagtttgttacataggtaatcatctgccacggtgg

SEQ ID NO: 32075 - DNA, 201 bp, Homo sapiens
ccccaagtagcccctggacctgcagtgtcagcatcacctggtagcttgttagacatagaaattcttgggctttattccacacataatgaatcagaagcttrtggggtggggcctgcagtctgacgtttattttttctaaaactttaagtttcagggtacatgtgtaagatgtgcaagtttgttacataggtaatcatctgc

SEQ ID NO: 32076 - DNA, 201 bp, Homo sapiens
cgaagacagagaccagaggttccccaagtagcccctggacctgcagtgtcagcatcacctggtagcttgttagacatagaaattcttgggctttattccasacataatgaatcagaagcttatggggtggggcctgcagtctgacgtttattttttctaaaactttaagtttcagggtacatgtgtaagatgtgcaagttt

SEQ ID NO: 32077 - DNA, 201 bp, Homo sapiens
tcaccaaatcacacctgaacaagaggaagaaaattaaactcattgaggagataccatcttttttaaaaaaaaaaaaaaaaggcagcaaaatgtgagatggscgtttattatgagatacacgaagacagagaccagaggttccccaagtagcccctggacctgcagtgtcagcatcacctggtagcttgttagacatagaaa

SEQ ID NO: 32078 - DNA, 201 bp, Homo sapiens
caaagaattaaaaccacccaccaggaaaatgggaaagtctcccctccacacacacacacacgcgcgcgcgcacacacacacacacacacacacacacacasaaaatcaccaaatcacacctgaacaagaggaagaaaattaaactcattgaggagataccatcttttttaaaaaaaaaaaaaaaaggcagcaaaatgtgag

SEQ ID NO: 32079 - DNA, 201 bp, Homo sapiens
taacccatatgggagaaatttccaaagaattaaaaccacccaccaggaaaatgggaaagtctcccctccacacacacacacacgcgcgcgcgcacacacayacacacacacacacacacacacaaaatcaccaaatcacacctgaacaagaggaagaaaattaaactcattgaggagataccatcttttttaaaaaaaaaa

SEQ ID NO: 32080 - DNA, 201 bp, Homo sapiens
gcttgtctcaacccctgagctcaggtgatccgcctgccttggcctgccaaagtgctgggattacagacatgagccaccaaacctggtcaattttctatggkgtgtgttacattttttaaaattttattttaatgtttatatagaaaaagttgccttatcaaccattataatcatggtatttagtgagtgtaatctgttctg

SEQ ID NO: 32081 - DNA, 201 bp, Homo sapiens
ccagagaattatttgactagttaaagcttaagaaacaccccagtggattatgagtgccttctagccaagaatgggtatttcctctgtgcaatctgagggcmcgggacactcctccagcggagtagcctgtgatttgtatgggctgcatgaattcctgcactaacaaggtaaaagaaggatgttaaagaaaacccgagatct

SEQ ID NO: 32082 - DNA, 201 bp, Homo sapiens
cccaagccttttttgccatctctttttcccagaaagactggaaacttgcctaaagagacagaatcccagatcccagatggatctactattttagaatctcygcttccgcatttctaaaatccttcccagagaattatttgactagttaaagcttaagaaacaccccagtggattatgagtgccttctagccaagaatgggt

SEQ ID NO: 32083 - DNA, 201 bp, Homo sapiens
ttaggtttgggtgtcctgtgtttgtaccttgttttgtgcccacctacatcctgggttatgtctttccccaccccaagccttttttgccatctctttttccsagaaagactggaaacttgcctaaagagacagaatcccagatcccagatggatctactattttagaatctctgcttccgcatttctaaaatccttcccaga

SEQ ID NO: 32084 - DNA, 201 bp, Homo sapiens
ttctatgcaactatatgtgggtgtatttttctgaacatgtcagtgaagtttaaatattcatctcacttctttcagtcaccctcaaaggggaatttaatttrcgacttcatttgtactttcaaacttcctcctggaaacagaagaaaataaaattagatttttgtaagctgagatgatatgcatgttcttattttcaataca

SEQ ID NO: 32085 - DNA, 201 bp, Homo sapiens
taaagtcccactgggtgtagattattcacagatgtatacacagtggctcactccaggtaggatgtgatcagtgcttttagaaatacagaaagtcctattgrtttaaaaaaaatttttttttgtaatgaattgagttttaaagctagcactgtacaataaaagggtgaatttcactatgaattatgacaaacacagtcatag

SEQ ID NO: 32086 - DNA, 201 bp, Homo sapiens
aggtggagcttgcagtgagccgagattgcaccactgcactccagcctgggcaggagacagagtaagactccatctcagaaaaaaaaaaaaagaattaataycaattttccacaaactcttttaaaaaaacagaagaggaggaaacactttccatctgacactgtgaagccactattactctgacaacagaggcagacaaag

SEQ ID NO: 32087 - DNA, 201 bp, Homo sapiens
gcttcagtgatatattgtgaaacatggctattcaacgtcctgtagaccaaatgccataagaaaaatagcattgattcaaacgtatccatccagatacctaraaaagttttacttcttaccacatcttgagtctgggcaaacacgcacttcctatggacattgattactgtctactgtagagataacatttgcacatacaga

SEQ ID NO: 32088 - DNA, 201 bp, Homo sapiens
ttggcgaggatggtctcagtctcctgacctcgtgatccgcctgccttggccttccaaagtgctgggatatacattttttttttttttttgagagatggagygtcactctgttgccgaggctggagtgtagtggcgcaatctcggctcactgcaacctcctcctccggggttcaagcgattctcctgcctcagcctccccag

SEQ ID NO: 32089 - DNA, 201 bp, Homo sapiens
ttcaagcgattcccctgccttagcctcctgagtagctgggactacaggcatgtgctaccacacccagctaattttttgtattttagtagagatggtttcascatgttggcgaggatggtctcagtctcctgacctcgtgatccgcctgccttggccttccaaagtgctgggatatacattttttttttttttttgagagat

SEQ ID NO: 32090 - DNA, 201 bp, Homo sapiens
ttattgctaccaattttaagaaatcctttataggactatttgtgaaattgattttgtgaggatgatgatataatttccattacattacagcatataaatayaaatatatatatatatatatatatatatatatatatatatatatatatatatattttattatttttttttgagacggagtcttgctctgtcaccaggctg

SEQ ID NO: 32091 - DNA, 201 bp, Homo sapiens
gaatgactaacattttctgagggtgtctcacgtgaaagtaaatcgctcatgtttgttctttttaaaagatgcccttcgtattgtgtatcttgcagtcttgstttctcaaacttaagccaactatatcgtcatttttgcaaaatcactgcgtcagtttactattatttaatgtttattgctaccaattttaagaaatccttt

SEQ ID NO: 32092 - DNA, 201 bp, Homo sapiens
atatcctcttttaggcaccatctctgtcaaggctgatgctgggctttttatatattttctctaattcttgtggctgtcaaacaaggtgggcattatcattscctttataggggacacagctgtggctcagaggggtttattcactttcctgagggccacacacataatgagaggcagacacaggtgacgaagtgagttttc

SEQ ID NO: 32093 - DNA, 201 bp, Homo sapiens
tagtattgctttatgcctacgaaatataatgttaatttgtagcaatgctaatgtgttttcaggaaggctctttgtttattgcctttattttccccacttascaagtgggtaaaatgctttgagggttgcattttatgtattcaggaggcccaggtattattttaatagaagcactattgacaaataccagtcatcccccct

SEQ ID NO: 32094 - DNA, 201 bp, Homo sapiens
ctgccaccacctattaaagcccactccctgcattaaaactgtataaagtgtatttaaataaactctctttgcatgatgtgaatgaaatcgtcatctggtamttaaaactattctataaagttattaaaaaattaatgttcccttcccatgatttttctgcagaatttatgcatccatgatactgcagaagttcataaataa

SEQ ID NO: 32095 - DNA, 201 bp, Homo sapiens
aaatgcatgagatgttttattttttgagtgacttgaccacgtgcttaagcacattccccaaacaatttttttcttattgtttgtaagttgtaagttgtaarttcacctctgccaccacctattaaagcccactccctgcattaaaactgtataaagtgtatttaaataaactctctttgcatgatgtgaatgaaatcgtca

SEQ ID NO: 32096 - DNA, 201 bp, Homo sapiens
tctctaggcaaaacagaggaaagagtcgtcattggcaagggagatgtacaaaatgcatgagatgttttattttttgagtgacttgaccacgtgcttaagcrcattccccaaacaatttttttcttattgtttgtaagttgtaagttgtaaattcacctctgccaccacctattaaagcccactccctgcattaaaactgta

SEQ ID NO: 32097 - DNA, 201 bp, Homo sapiens
tagaggttcatttatgttattgcaaaaatcagtacttcatttctttttatggctgaaaaaaattccattatgtagatgtgccatatttgtttatctggttstcagtcggatatttctgttgttcctactttttggctactgtaaaagatgctgctatgaacattattgtgattattataccttatttgtaaacatcatggg

SEQ ID NO: 32098 - DNA, 201 bp, Homo sapiens
ttctcctgcctcagcctactgagtagctgggattacaggtgtgcgccaccacgcttggctaatttttgtatttttagtagacacggggtttcaccatgttrgttaagctggtctcaaactcctgacctctagatccgcctgcctctgtaatcccaaagtgctgggattacaggcgtgagcccctatgcccagccaaaattc

SEQ ID NO: 32099 - DNA, 201 bp, Homo sapiens
ctggagtgtgatggtgtgatcttggctcactgcaacctctgcctcctgggttcaagtgattctcctgcctcagcctactgagtagctgggattacaggtgwgcgccaccacgcttggctaatttttgtatttttagtagacacggggtttcaccatgttggttaagctggtctcaaactcctgacctctagatccgcctgc

SEQ ID NO: 32100 - DNA, 201 bp, Homo sapiens
tgacctgcagtgagaccacccacgcagacatcaatgcagcaaatccccggcgtcagggtttcaacatttggttactctcagagaactctcgatttatatamgacttggaaaaagggtttgagtttctgtggtttacaattatatttcccaacttggcccatgaatccagcttggtttttctcctcttagcatcctaaccac

SEQ ID NO: 32101 - DNA, 201 bp, Homo sapiens
tttgacctgcagtgagaccacccacgcagacatcaatgcagcaaatccccggcgtcagggtttcaacatttggttactctcagagaactctcgatttatayaagacttggaaaaagggtttgagtttctgtggtttacaattatatttcccaacttggcccatgaatccagcttggtttttctcctcttagcatcctaacc

SEQ ID NO: 32102 - DNA, 201 bp, Homo sapiens
tacctttgtagatcttgggaaacaacttctaaagtaatcatagttgtatgtaatcgtagttacaacaatagttattttaggcacataacccaaaggttttmttacaaggaatctatgaaccttaagagtgagggcttctgttaagagtaagggcttccctggagtggacatggatcatgggactgagccagcttggcattg

SEQ ID NO: 32103 - DNA, 201 bp, Homo sapiens
ggctggctagatggatggaaggggtggaaggggatgcaagaggtaagtacaaggaaggggatgggtggctggctggctagatggatagaaggttggaagasaggaaggatggaacggaagaagagggaagaacaaaaatggaaacacatagtactgttaggtgaactgaacttctaaggtgccgattctcagtgatagaat

SEQ ID NO: 32104 - DNA, 201 bp, Homo sapiens
aatatctgtgctacaacttattaagatggtgacgctggcaaattccttaatctttctaattcttaatttcatcagcaaagatgggaaaggatactaacacmactctgggttgttgagaggattcaataactgaatatttataaagcgtagtacctgatacttaataaaaaagtgaattttaacctgtgtcatcattgtcat

SEQ ID NO: 32105 - DNA, 201 bp, Homo sapiens
gcctagtgggacaattagaaaggtcagttcaaggttggaggagatgcttctttcagccaattttcctttttctcaggatcacctcaggtgatccgcccacytcaacctcccaaactgctgggattataggcgtgagccaccgctcctggcctttcagccaattttctatcaccaaagggaaatcgttttgctggaatatgt

SEQ ID NO: 32106 - DNA, 201 bp, Homo sapiens
gttcatgctagctggtacgcagtaaggctagaacttcgtccaaaatctcttcttctgttgagctcagcttgcatagtagcttggagaatcagaaagatctrtctcatttgggaaatataccatgtaaaaaacattgtttctaaaggagatttgtcccatgagtaaaatagatgatggacagccactgcctagtgggacaat

SEQ ID NO: 32107 - DNA, 201 bp, Homo sapiens
gagattggaaataaagcttatgccttctctcatatctcctgtaccttatttctttcttacagtagttgtgatgcttagcagttttttgataactttttatratgccaaccttcaaaaacctgcccctggtggagagaataattattacatcaattaggggtcacttagcatgacatttgtcggaaaaaaaaaagttagtga

SEQ ID NO: 32108 - DNA, 201 bp, Homo sapiens
aggacacagattcacaggggtgaactaactggccatgagtcaggtaaggaaaataacatggctgagctacagtttctctaagaagttggttctgtccattycagggagcttatgtaagacagaaggtattgtgcagtagccttgaagtcaggtgaccctttgggggtgtgtgtgtgtttgcttctttatattagctttttt

SEQ ID NO: 32109 - DNA, 201 bp, Homo sapiens
atgcctataatcccagcgcttttgggaggccaaggtgagaggattgcttaagcccagaaacgtgagaccagcctgggcaacgtagtgagacgctgtctctrtattacaaaattttttaaaaaacggtttgtaggtccttaagtccctgataaaatagagaactgaattgcaatcctggaacttaaaaagttggtgacgaca

SEQ ID NO: 32110 - DNA, 201 bp, Homo sapiens
cagggctcccaccgattgtacattatggtgagttggataactatttcattatatattacaacgtaataataatagaaataaagtgcacaataaatgtcatstgcttgaatcgtcccaaagccacccccactcctttgagtctatggaaaaattgtcttccagaaaaccacttgctggtgccaaaaaaatttggaaacctct

SEQ ID NO: 32111 - DNA, 201 bp, Homo sapiens
gtccatgacctctaggccacaaaccaatagcggagccgtggcctgttataaattgggtggcatggcagggagtgagtggtgggcaagcataggaagctgcrtctgtgcttagagccgctctctgtcactctcattagtgcctcaggtcctccccctgtcagatcagcaacagcattagtctcataggaccgtgatccctat

SEQ ID NO: 32112 - DNA, 201 bp, Homo sapiens
aaaacaacataaaacaagaaacatttctgttgtgcctcctcttttcctccctccctctttctcatagttaatttgtttgaatcaggattcaaataaggtckatgcatttttaatctataggttttgtctcctttttttttttttccttaaaaaaatttcttttaatgcaacagatttaagggaccagggtgttctctagag

SEQ ID NO: 32113 - DNA, 201 bp, Homo sapiens
tggggtgggcagaggttgcagtgagccgagatcatgcctgggggacagtgagactctgtctcaaacaaattactccaaaatttagtggctaaaaaacaacrtaaaacaagaaacatttctgttgtgcctcctcttttcctccctccctctttctcatagttaatttgtttgaatcaggattcaaataaggtcgatgcattt

SEQ ID NO: 32114 - DNA, 201 bp, Homo sapiens
actcctgacctcaagtgatctctccaccttggcctcccaaactgctggaattacaggcgtgagccaccctgcccgaccctttcattttaaatgtgatagaracagactcagagaatgtgagtgactttcgcagggtcacttagcaggttggtgacgggcatggggtttcactccagtctgcctcttgttcttttcctcata

SEQ ID NO: 32115 - DNA, 201 bp, Homo sapiens
aggctagtcaactcctgacctcaagtgatctctccaccttggcctcccaaactgctggaattacaggcgtgagccaccctgcccgaccctttcattttaamtgtgatagaaacagactcagagaatgtgagtgactttcgcagggtcacttagcaggttggtgacgggcatggggtttcactccagtctgcctcttgttct

SEQ ID NO: 32116 - DNA, 201 bp, Homo sapiens
gtttcaccatgttggccaggctagtcaactcctgacctcaagtgatctctccaccttggcctcccaaactgctggaattacaggcgtgagccaccctgccygaccctttcattttaaatgtgatagaaacagactcagagaatgtgagtgactttcgcagggtcacttagcaggttggtgacgggcatggggtttcactcc

SEQ ID NO: 32117 - DNA, 201 bp, Homo sapiens
actatactgtgtttcattttagtttattttttatttattttttgagacagggtctcgctgtgttgcccaggctgaagtgcagtggtgcaatctctgttcawtgcaacctctggccttgggttcaagcgattctcatgcctcatcctccagagtagctgggattacaggtgcaggttaccacacacagctaatttttgtatt

SEQ ID NO: 32118 - DNA, 201 bp, Homo sapiens
ccaccctttgccagaactatcaagaggcacctcaacaggctgcaacactagcattcaagacatttgttcgctgatttgcttcgtcattcatttatccaccsgttccttcacttcacacacatttcaggagcacctctaaagccccagacattcttctgggctctgagaagagagtggtggccctggaagccacagtaaccg

SEQ ID NO: 32119 - DNA, 201 bp, Homo sapiens
gtgcactccagcccgggtgacaagagcaaaactctgtctcaaaaaaaaaaaaaaaaaattgactcaggctcttgctggagtatgtcagtgtcccaagtcaytgaggtctacattagagtcagtcttagtgagagttgcaacatcgcctaagcgcagaccccaagctggcttgtaggaacagtgagataacatcccccagcc

SEQ ID NO: 32120 - DNA, 201 bp, Homo sapiens
agctgagactgaaccagtgcactccagcccgggtgacaagagcaaaactctgtctcaaaaaaaaaaaaaaaaaattgactcaggctcttgctggagtatgycagtgtcccaagtcattgaggtctacattagagtcagtcttagtgagagttgcaacatcgcctaagcgcagaccccaagctggcttgtaggaacagtgag

SEQ ID NO: 32121 - DNA, 201 bp, Homo sapiens
tgagactccgtctcaaaaaaaaaaaaaaaaaaaaaaaagtttgtactcagcctggcgtggtggctcacgcctgtaatcccagcactttgtgaggccgaggkgggcggatcacctgaagtcaggagttcgagaccagcctgggcaacaaggtaaaaccccgtctctactaaaaatgcaaaattaactgggcggggaggcaca

SEQ ID NO: 32122 - DNA, 201 bp, Homo sapiens
gacagattgagactccgtctcaaaaaaaaaaaaaaaaaaaaaaaagtttgtactcagcctggcgtggtggctcacgcctgtaatcccagcactttgtgagsccgaggtgggcggatcacctgaagtcaggagttcgagaccagcctgggcaacaaggtaaaaccccgtctctactaaaaatgcaaaattaactgggcgggg

SEQ ID NO: 32123 - DNA, 201 bp, Homo sapiens
ccagcctggcgacagattgagactccgtctcaaaaaaaaaaaaaaaaaaaaaaaagtttgtactcagcctggcgtggtggctcacgcctgtaatcccagcmctttgtgaggccgaggtgggcggatcacctgaagtcaggagttcgagaccagcctgggcaacaaggtaaaaccccgtctctactaaaaatgcaaaattaa

SEQ ID NO: 32124 - DNA, 201 bp, Homo sapiens
aacccggagatttgtccttgcagaatgatgccatgaagaacatggccaatggaacaccattgcttcaaatcccgacctctccagttctcctggtttcttgytaggcgggaacttgggcttctttatcagtgactggggtcagttcttgtactcaacttcctatctctgtgatctcttgtaagatgctgcattgtcaaatgg

SEQ ID NO: 32125 - DNA, 201 bp, Homo sapiens
tctagctgtcactgcctgatgtttactgctcaaagcttaggacttggattagagcccaggacttggcagccaagataaaccaggtgcaattacgctgaacrtctcagcccagctcctgtccatccctgaacaggacacttagggtagaggatgttctcagcagtgccatttgcatcccccttcatagccttacaggtatca

SEQ ID NO: 32126 - DNA, 201 bp, Homo sapiens
catcactttctaccacctttccttaaaactaggcttcgtgccaggtgcggtggctcacgcctgtaatcctagcactttcggaggccggggtgggtggatcmcaaggtcaagagattgagaccatcctggccaacatggtgaaaccccgtctgtactgaaaatacaaaaataagctgggtgtgttggcacgcacctgtagtc

SEQ ID NO: 32127 - DNA, 201 bp, Homo sapiens
tccctttgcagtaggaagtgccacctcactccactcttgccagaaagcctggctctgtcataaggaatcttggcccattgtcactctcattgatgacaacscccgcccccaccactaccaccttaactactgaggggatgtcctctggcccagaaggaatgcattggctctagttgaaggggttgctggtttgtaaatagc

SEQ ID NO: 32128 - DNA, 201 bp, Homo sapiens
aatgatgggtagtagagtctgtatacataatttaaaatacattaacatttctgttttgcctgagataagcttgtactggtgtgatcagaaggaagaatgargatttggggaaggaaaattttgagagccattttacagcatttcaagattcagtgatctcagaacctcttttggttaaacaagcatgggaagatggatgat

SEQ ID NO: 32129 - DNA, 201 bp, Homo sapiens
ttctctgtttaaataccacacactccccatatggtttctttggtttcaggcagtatcgcatcagagtcacatatggctaatttatagtcataaaatgataytagagatcactgttgcataacaacaagaaacccctttgattccacacttacagactcttgagtcactaacacaggtttcagtatatataaagaatagatg

SEQ ID NO: 32130 - DNA, 201 bp, Homo sapiens
gctatagggataaataactgctgtggggcaaggactgaaatggttgttgttttgagatggcttttatcattgggccagtgacgacccattcagccctatcrgtgaagagtgaagcactgcactctttaaggatagggctgaatggtttatcacccattcagcggtgaccaccacatcttatgcattgtgatgatcacgatg

SEQ ID NO: 32131 - DNA, 201 bp, Homo sapiens
tataattataatacaatattatatataatatatattttatgtaactataaacaaggggtagattactcatgagttttcacggaaaggggtaggcagttccyggaagtgagggttcttcccctttttagaccatatagggtaacttcttgatgttgccatggcatgtgtacactgtcatggtgctggtgggagtgtctctta

SEQ ID NO: 32132 - DNA, 201 bp, Homo sapiens
ggaaacaacataaaataatattaccggagaaacaatgagtaacatgtataggattttttttttttttttttgacggagtcttgctctgttgcccaggctcsagtgcagtggcgtgatgttggctcactgcaactccgcatcctggtttcaagtggttcttctgcctcagccttccaattagcggggactaccagcgcatgt

SEQ ID NO: 32133 - DNA, 201 bp, Homo sapiens
aaccgtcgtcgtcatttctcaagcgtgacgatactgttacacgtttactgcatattctgcataccaagcacatatccgtcacacgcagtgtggccaacttycgagaggccggcattcagccaaacagcctgaagaaccaggagaaatgcctgagtttccaaatggcttatggtaagttgttgctgccactatgagtagcct

SEQ ID NO: 32134 - DNA, 201 bp, Homo sapiens
gagaagtattctgagggacagctagttctatctgcagtgtatcttttttaaacagcatagaactattttttttttttaattctagtcttggtttctgcctytcaatgtgtgaatttaagttcatgtttcttttgatgactgataaatttgaaataatttctgtatttcattgtgttttcttcactaccaagtttttcttat

SEQ ID NO: 32135 - DNA, 201 bp, Homo sapiens
tcttctgctcagtgaccattagtggaaatgtaaatatctcacctcaatgcagtgtgggttaggaaatgtggctttctgtctagtcaacctctttttcctaygctgtggaaagaggagaagtattctgagggacagctagttctatctgcagtgtatcttttttaaacagcatagaactattttttttttttaattctagtc

SEQ ID NO: 32136 - DNA, 201 bp, Homo sapiens
ttgctcccttattctcacacagagaacatattcacttttcttccaaaggcagagtctcaaaatcccatttaattctttgattctgtgcaaattctagggtstccttcatgcttagatatggttccttatggtcctgtgggtttcagaaaggcagcccattcatgccgtctacccccctgctgctctatataatagaaggtg

SEQ ID NO: 32137 - DNA, 201 bp, Homo sapiens
aaaagaatccatatttttatgtgtagtgttctgtagctcttttagttggtttatactcttttaatggtctgttgaccattttatctaaatattccattttrtcttttacttatttctattataaatggttaatctcttctactaagattgttaaatccatctttttgtttatggctgtgttatttggcacatgcaagttca

SEQ ID NO: 32138 - DNA, 201 bp, Homo sapiens
atataacttttttaagatgaaaaccatttattttcaatttctagtttaactgcctcacagtaaaaaagtgtactttttgtgatggcaggaatttgaagtaygttgaaactgcctttgtgatctggctcatggttaacttcaataacgtatgaaaagaatccatatttttatgtgtagtgttctgtagctcttttagttggt

SEQ ID NO: 32139 - DNA, 201 bp, Homo sapiens
ctgttcttcatcctttaattagcattcaaactaatcgttattagagtgtgtaacatgatctttgacatacctaggtaattttacttaagtatatgagttawgttgatacgcacagttcctcagcatgaatgtcattgttttgcaaattttagctgaaggtgacatcactgtactaaaattttcttgtgcatccacttccta

SEQ ID NO: 32140 - DNA, 201 bp, Homo sapiens
agatgcatacaaaatggaagatggccaacatttctaaaaattttgtttcctgacatagagaacgtttagaggtcaggttgctctgagactgtgttgtgatktcttttttttttttttttttttacttgtttgtcctttcttttattatctcttgctgttatcctcacttttttctttgctgttcttcatcctttaattagc

SEQ ID NO: 32141 - DNA, 201 bp, Homo sapiens
aaacatctaagtttccattccttataactgattatttttcttgggatcaattctggtcttcaccatctgccaatgtgagttttagtttctctataaacttktaaactttaaactttttttcttttttttttgggggggggggcaatccattcttaacccccttccagtttttctcagcctattcttgtttgtttttgtttt

SEQ ID NO: 32142 - DNA, 201 bp, Homo sapiens
catattctgggagaaacatctaagtttccattccttataactgattatttttcttgggatcaattctggtcttcaccatctgccaatgtgagttttagttyctctataaacttttaaactttaaactttttttcttttttttttgggggggggggcaatccattcttaacccccttccagtttttctcagcctattcttgt

SEQ ID NO: 32143 - DNA, 201 bp, Homo sapiens
aatgtttctattcttctgttctgttcttaaagtatgcctgtaattattaggatataattaaggattctgtcttatttattttttaatcttcttactgtgtytatcttttgtctttctccatattctgggagaaacatctaagtttccattccttataactgattatttttcttgggatcaattctggtcttcaccatctgc

SEQ ID NO: 32144 - DNA, 201 bp, Homo sapiens
attttaaatgtttctattcttctgttctgttcttaaagtatgcctgtaattattaggatataattaaggattctgtcttatttattttttaatcttcttaytgtgtctatcttttgtctttctccatattctgggagaaacatctaagtttccattccttataactgattatttttcttgggatcaattctggtcttcacc

SEQ ID NO: 32145 - DNA, 201 bp, Homo sapiens
atctacgatgttttctttttgatttttttatgtcattttaaatgtttctattcttctgttctgttcttaaagtatgcctgtaattattaggatataattawggattctgtcttatttattttttaatcttcttactgtgtctatcttttgtctttctccatattctgggagaaacatctaagtttccattccttataactg

SEQ ID NO: 32146 - DNA, 201 bp, Homo sapiens
caaattcaaaataccgtttacattgggaaagggaaaaaggagagaaatatatgagagacgtatgctgggggtatctacgatgttttctttttgattttttwatgtcattttaaatgtttctattcttctgttctgttcttaaagtatgcctgtaattattaggatataattaaggattctgtcttatttattttttaatct

SEQ ID NO: 32147 - DNA, 201 bp, Homo sapiens
cattggataaatatcaaattcaaaataccgtttacattgggaaagggaaaaaggagagaaatatatgagagacgtatgctgggggtatctacgatgttttytttttgatttttttatgtcattttaaatgtttctattcttctgttctgttcttaaagtatgcctgtaattattaggatataattaaggattctgtcttat

SEQ ID NO: 32148 - DNA, 201 bp, Homo sapiens
aggcagcacagtgctgtaatggaaaccataagggcacgcacaatggctcatgcctgtaatcccagcactttgggaggcagaggcgggaggatcacataagrccaggagtttgagaccagcctggccaacatggtgaaaccccatctctactaaaactacaaaaatagccaggtgtcctggtgcatgtctgtaattccagct

SEQ ID NO: 32149 - DNA, 201 bp, Homo sapiens
attaggagcatcatagctaatgtatgctcagggcttactgtgtgctagacattattctgagtttacacagtgatgtcagatttctcctctgtcacagtaarttccaaaagatagtgaagaatattgcagtgaaaacactgaaactcacatatttcatactcaggggtatcttttaagtgtgaagcaagagaaaaaaacgtg

SEQ ID NO: 32150 - DNA, 201 bp, Homo sapiens
tttcccttttttttttaactattcttctttagagtttgttttctcattgaacttgtgatgtacacattaaaggaaaactcattaatgtggaaaattaggarcatcatagctaatgtatgctcagggcttactgtgtgctagacattattctgagtttacacagtgatgtcagatttctcctctgtcacagtaagttccaaa

SEQ ID NO: 32151 - DNA, 201 bp, Homo sapiens
cgtatgcactgacagaatggtacatcccaccactgctctgtgtctgtgtgcgactgtcagctgctctctactgctcctcatagacttcctgtctgcctttytctgcatttctcagtctccccatctccccttcttatctaatccccttccttcctctctcaactcttccttcctctatcctttttctttcccttttttttt

SEQ ID NO: 32152 - DNA, 201 bp, Homo sapiens
catcgcgattcatttgtcccattgggccatgggataggtgactacagagccagattcgaatgtggccctgtgccggtgcccaaaccagcaggctgcacgtrtgcactgacagaatggtacatcccaccactgctctgtgtctgtgtgcgactgtcagctgctctctactgctcctcatagacttcctgtctgcctttttct

SEQ ID NO: 32153 - DNA, 201 bp, Homo sapiens
cctcagcctcccaaagtgctgggattacaggtgtgagcctctgtgcccggcttctgccagcttctcattatgatttttgagcagatttcgctgctttttckgcctttgttgtgtttataaactagaagtaattatgtcaactttgtaagggctcagtagcgtagaataaggccatgtctgtaatctccccttctgtgaaca

SEQ ID NO: 32154 - DNA, 201 bp, Homo sapiens
actaccatcccatttgggccaacctcttttttttttttctttttgtttcgagatggagtctcgctctgtcaccaggctggagtgcagtggtgcaatctcarctcactgcaacctctgcctcccgagttcaagctattcttctgtctcagcctcctgagtagctgtgattacaggtgcgtgacaccacaccccgctaatttt

SEQ ID NO: 32155 - DNA, 201 bp, Homo sapiens
gacgtagtcttgctctgttgcccaggctggagtgcagtggtgtgatttcggctcacagcaagctctgcctcccaggtttacgccattctcctgcctcagcytcctaagtagctggtactacaggtgcctgccaccacgcccggctaattttttatatttttagtagagacagggtttcaccatgttagccactttggtctc

SEQ ID NO: 32156 - DNA, 201 bp, Homo sapiens
ttttttttgtatcacaaaagttacattttttttttttttttttttttttaagacgtagtcttgctctgttgcccaggctggagtgcagtggtgtgatttcrgctcacagcaagctctgcctcccaggtttacgccattctcctgcctcagcctcctaagtagctggtactacaggtgcctgccaccacgcccggctaattt

SEQ ID NO: 32157 - DNA, 201 bp, Homo sapiens
ggggggtggatgtaggagagaagttgaaattagctggggttttttttttgtatcacaaaagttacattttttttttttttttttttttttaagacgtagtsttgctctgttgcccaggctggagtgcagtggtgtgatttcggctcacagcaagctctgcctcccaggtttacgccattctcctgcctcagcctcctaagt

SEQ ID NO: 32158 - DNA, 201 bp, Homo sapiens
attcgtggtcatttggaaagaaaagtatgttaagacaaaatgagcaggtggttggattagtattttctttctacacatatagaaactgttcctatcatacstgactcagttttcaaactggcttaatccaaagcctggggggtggatgtaggagagaagttgaaattagctggggttttttttttgtatcacaaaagttac

SEQ ID NO: 32159 - DNA, 201 bp, Homo sapiens
aaatttctgtgtcttcatttgcaactctcttttctccagtaaagaggaaagtgtatagttctcctttccttacagaaacattattttgttattgttgtttkggtttgggtttctgaagtataaatgcatatgaactggacagaaggattatgcccatgtgccaggtggccaagatggggcttgtgatttgaagcttctttt

SEQ ID NO: 32160 - DNA, 201 bp, Homo sapiens
gaagaaatagcctcattagtaacttttctgtaagcaatctccttatttcttgttttttgttcttttgttttttgtgtgtgcttctgcgtgcacctcctctrtggctccccccaccaaatttctgtgtcttcatttgcaactctcttttctccagtaaagaggaaagtgtatagttctcctttccttacagaaacattattt

SEQ ID NO: 32161 - DNA, 201 bp, Homo sapiens
ccagatgtggaagaaatagcctcattagtaacttttctgtaagcaatctccttatttcttgttttttgttcttttgttttttgtgtgtgcttctgcgtgcmcctcctctatggctccccccaccaaatttctgtgtcttcatttgcaactctcttttctccagtaaagaggaaagtgtatagttctcctttccttacagaa

SEQ ID NO: 32162 - DNA, 201 bp, Homo sapiens
cagtttagtgcctgccaagagtaactggtgggtctgtgtcaccttctgacatgatcagtgtgattgtctccaacgcatccatggaagtgaaaccgttggargaagctaatgccgtgagccagctgttggttatgtttttgttttgtttttcttttttacttgctggatagtgggttctgtttattgagaaatatttacatc

SEQ ID NO: 32163 - DNA, 201 bp, Homo sapiens
gtgcccagtttagtgcctgccaagagtaactggtgggtctgtgtcaccttctgacatgatcagtgtgattgtctccaacgcatccatggaagtgaaaccgytggaggaagctaatgccgtgagccagctgttggttatgtttttgttttgtttttcttttttacttgctggatagtgggttctgtttattgagaaatattt

SEQ ID NO: 32164 - DNA, 201 bp, Homo sapiens
gaaagaaaaaaaaaatttgtggttacagtataataaaaataaactgtttgtcgtgactgcagctgacatttatcagcctgtttgtgggtgatctttctctytctctataatacagaacataatttgtcactttgtaaatacattccagtctaaatccctgccagcatctgttagtgtttgaaggattaatgtgctaccctg

SEQ ID NO: 32165 - DNA, 201 bp, Homo sapiens
aaaaaaatgggaaagaaaaaaaaaatttgtggttacagtataataaaaataaactgtttgtcgtgactgcagctgacatttatcagcctgtttgtgggtgmtctttctctctctctataatacagaacataatttgtcactttgtaaatacattccagtctaaatccctgccagcatctgttagtgtttgaaggattaatg

SEQ ID NO: 32166 - DNA, 201 bp, Homo sapiens
ccccaaagtagctgggaccacaggtgcacaccaccacttccagctgattatttaaaaaaaattttgtagtgacagtgtcttgctgtgtttcccaggctgtycttgtactcctgggctcaactgatcttcccagcttggcctcccaaagtgctgggaatacaggtgtgagccactgtcccaggccagttttaactcacaatg

SEQ ID NO: 32167 - DNA, 201 bp, Homo sapiens
tttttttgacggggtcttaatatgtcacccaggctgtagtgcagtggcgcgatgacagcccactccagccccaaactcccaagctccagtgattttccttyctcagaccccaaagtagctgggaccacaggtgcacaccaccacttccagctgattatttaaaaaaaattttgtagtgacagtgtcttgctgtgtttccca

SEQ ID NO: 32168 - DNA, 201 bp, Homo sapiens
tccatatatttttaaaatgttgcttttagagtatgtgcaagtttggggcatttttgagggcttttttttttgacggggtcttaatatgtcacccaggctgyagtgcagtggcgcgatgacagcccactccagccccaaactcccaagctccagtgattttccttcctcagaccccaaagtagctgggaccacaggtgcaca

SEQ ID NO: 32169 - DNA, 201 bp, Homo sapiens
ccatttattctgttgctgaaaccattccagctttttctggttggcttctatgaaggacgctattttaatggggtgatttttttcttctcactacattcttsctcactccccactttttatgtccggtggccataggctggtgagaacttgattttgaacagttgaaggtctgctgttagggacgtgctaatctagggaatt

SEQ ID NO: 32170 - DNA, 201 bp, Homo sapiens
ttctttcttttcttttctttttgttgagacaaagtttcactcttgtcgcccaggctggagtgtaatggtgcgatatcggctccctgcaacctctgcctccygtgttcaggcgattctcccgtctcagcctcccaaggagctgggattacaggtccatgccaccatgcccagctaatttttatatttttagtagagatgggg

SEQ ID NO: 32171 - DNA, 201 bp, Homo sapiens
ctttttatagtcagtaattggaattcttctgaagaaagagctatcccttctcccccatttctttcttttcttttctttttgttgagacaaagtttcactcytgtcgcccaggctggagtgtaatggtgcgatatcggctccctgcaacctctgcctcccgtgttcaggcgattctcccgtctcagcctcccaaggagctgg

SEQ ID NO: 32172 - DNA, 201 bp, Homo sapiens
attcaatcattagaaaataattttaaatgagcttagcagttctcagaattttggatttcaggaaacaaactttttaaaaacaaaacaaaaaggaggatacsaatttaagcttgtcaaaaagattttcccccaaaagaaaaacacattaaaaacaacgacaaaaatcaacaaaaactaacactgttcccccatcaacaatca

SEQ ID NO: 32173 - DNA, 201 bp, Homo sapiens
ctcataattcggtgtgagaaacacacaaggcatgatgccattcccatctgggatgaacagggaagacttcctgggagaggtgactatggacttaattttgytttgacacagcaaaaacatgaggaatgaattttgtgacttggaagattgttagttttctgtggagggaacaacactcatcttgcaaatttgccttcacta

SEQ ID NO: 32174 - DNA, 201 bp, Homo sapiens
gcattttacataaaaacctctaaagctctcaggctaattagtaatgtagcatatacaaattaagtttttttctgctgtgcttaattcttattaacacactmatcatgagagcccccaaattgctgtaaggagcacatttagaaaacatataaaggatcgatagttggtacttaagaaatcgttgaaacaccttttcttttt

SEQ ID NO: 32175 - DNA, 201 bp, Homo sapiens
gcagtgtctgagtgtctgtaccttcctataccttcaccatatcatgtatttgtcattttatagtgagttgtattacttgctaggtgagctggtatctcctytgataacacaaagaaggcctgggtttgcttggcaatttgttccaatattcttttcagttttaaataagttttgaacaaaaagttttagcattttacataa

SEQ ID NO: 32176 - DNA, 201 bp, Homo sapiens
gtcatgagcaacgttgctggtttacctggggctaaataagaagtttaaatgcaaatagataattcttgagaaagcttcttccctgtatatactctttctgyagcagtgtctgagtgtctgtaccttcctataccttcaccatatcatgtatttgtcattttatagtgagttgtattacttgctaggtgagctggtatctcc

SEQ ID NO: 32177 - DNA, 201 bp, Homo sapiens
gttttccattttttcagtcatgagcaacgttgctggtttacctggggctaaataagaagtttaaatgcaaatagataattcttgagaaagcttcttccctrtatatactctttctgcagcagtgtctgagtgtctgtaccttcctataccttcaccatatcatgtatttgtcattttatagtgagttgtattacttgctag

SEQ ID NO: 32178 - DNA, 201 bp, Homo sapiens
ctgttttccattttttcagtcatgagcaacgttgctggtttacctggggctaaataagaagtttaaatgcaaatagataattcttgagaaagcttcttccytgtatatactctttctgcagcagtgtctgagtgtctgtaccttcctataccttcaccatatcatgtatttgtcattttatagtgagttgtattacttgct

SEQ ID NO: 32179 - DNA, 201 bp, Homo sapiens
ttattgctgggcacagattctgttttccattttttcagtcatgagcaacgttgctggtttacctggggctaaataagaagtttaaatgcaaatagataatkcttgagaaagcttcttccctgtatatactctttctgcagcagtgtctgagtgtctgtaccttcctataccttcaccatatcatgtatttgtcattttata

SEQ ID NO: 32180 - DNA, 201 bp, Homo sapiens
taaattaatcccttattgctgggcacagattctgttttccattttttcagtcatgagcaacgttgctggtttacctggggctaaataagaagtttaaatgyaaatagataattcttgagaaagcttcttccctgtatatactctttctgcagcagtgtctgagtgtctgtaccttcctataccttcaccatatcatgtatt

SEQ ID NO: 32181 - DNA, 201 bp, Homo sapiens
gaattttgtgtagcttttcctgactttttaaaattcaaatatatttcataaagttgaaatcacactgtggtctttttttttttttttttttttttaaccaracatatagtggccatgtttctatgtcaatacatactgtttggcagtacagttgtactgacttgacattatagcttcataacttagtaaattaatccctta

SEQ ID NO: 32182 - DNA, 201 bp, Homo sapiens
acaaatgagggaaaatatacaaatgagttgaatatatacaaatgagggaaaaattgttccttgtgtcaggaacaattactgtgaattttgtgtagcttttyctgactttttaaaattcaaatatatttcataaagttgaaatcacactgtggtctttttttttttttttttttttttaaccaaacatatagtggccatgtt

SEQ ID NO: 32183 - DNA, 201 bp, Homo sapiens
tatacaaatgagggaaaatatacaaatgagttgaatatatacaaatgagggaaaaattgttccttgtgtcaggaacaattactgtgaattttgtgtagctyttcctgactttttaaaattcaaatatatttcataaagttgaaatcacactgtggtctttttttttttttttttttttttaaccaaacatatagtggccat

SEQ ID NO: 32184 - DNA, 201 bp, Homo sapiens
cttgaacctgggaagtggagtatgcagtgagccgagatagttctactgcactccagcctgagcaacagagcaagactccgtgtcaaaaaataaataatatrtgtgtgtgtgtgtgtatgtacatgaattatatacaaatgagggaaaatatacaaatgagttgaatatatacaaatgagggaaaaattgttccttgtgtca

SEQ ID NO: 32185 - DNA, 201 bp, Homo sapiens
ctgggtagaacacacataatgaaccatatgcacgagaactttttcatctttctgcatacacttggaactagttctttgttattgtaaaagcatcatgcacyaggtaaaatgtttaataacacagagaaatctaattgtcaagtatcttctcaacacacattaatcaacaattctcatatcgaaggataacctcttgtattt

SEQ ID NO: 32186 - DNA, 201 bp, Homo sapiens
tgtggagctgtgcattagggctgggtagaacacacataatgaaccatatgcacgagaactttttcatctttctgcatacacttggaactagttctttgttwttgtaaaagcatcatgcaccaggtaaaatgtttaataacacagagaaatctaattgtcaagtatcttctcaacacacattaatcaacaattctcatatcg

SEQ ID NO: 32187 - DNA, 201 bp, Homo sapiens
gcttctccctgcatagccacttctctttccagtggtgtttgtattttggttcattcaatcaatgaatgattgattgaatcaaccacttggtcccttcaatytgtaaccttcctgcaacactgtctttgtgatgttatcataaccttgatttttgagggatagaattgggcataatcagagaaaacgtggtctgggacacat

SEQ ID NO: 32188 - DNA, 201 bp, Homo sapiens
ggaaggagatatgacacatctctagtttgttgtaagtcgcctaccctagacctcatctccagtgctctgaatgtggagaggtaggtgcagggcagtgggayagagaggtgcactttgaaagactatcacatggaaacaaaagttccggctgggcacggtggctcacgcctgtaatccaagcactttgggaggccaaggcga

SEQ ID NO: 32189 - DNA, 201 bp, Homo sapiens
aagtacaaaaaattagcctggcgtggtggcgggcacctgtagtcccagctactcgggaggctgagaccgaagaattacttgatgaaacatggcagacgacrtagaccagcagcaaactaccaacactgtggaggaccccctggatcttaggctcagcccagaggagcgaatttgtgtgaaaatgagaaacgaccgagagct

SEQ ID NO: 32190 - DNA, 201 bp, Homo sapiens
taaaagtacaaaaaattagcctggcgtggtggcgggcacctgtagtcccagctactcgggaggctgagaccgaagaattacttgatgaaacatggcagacracatagaccagcagcaaactaccaacactgtggaggaccccctggatcttaggctcagcccagaggagcgaatttgtgtgaaaatgagaaacgaccgaga

SEQ ID NO: 32191 - DNA, 201 bp, Homo sapiens
cctttttttctctgaagtcattgctcctgtgtgtgtgtgtctgtatataaaaaaaagtatgtatacatatacgtatatgtatgtgtatagataaaaatgcrtgtatggtgctgggcgcagtggctcacgcctgtaatcccagcactttgggaggctgaggcgggcgaatcacgaggtcaggagatcgagaccatcctggct

SEQ ID NO: 32192 - DNA, 201 bp, Homo sapiens
atcatcaaaaatagagatgacagccaggggtggtggtgcatgcctataatcccaacacttttggaggccaaggtgaggagaccacctgaggtcaggaattyaagactactgggcaacatggtgaagctctgtctatcctaaaaatgcaaaaattagccgggagtggtggtgcatgtctgtagtcacagctacttgggaggc

SEQ ID NO: 32193 - DNA, 201 bp, Homo sapiens
aaattttgttttctatttttcatgtttttgggtttttctagatggcctgtctttaacacttcttgatatttttgattaaattttcatatatcatcaaaaayagagatgacagccaggggtggtggtgcatgcctataatcccaacacttttggaggccaaggtgaggagaccacctgaggtcaggaattcaagactactgg

SEQ ID NO: 32194 - DNA, 201 bp, Homo sapiens
ttaattttgatgctggtttttgatgatgtattgaaaacttgtataaactggcaattacaactggaaaacatttctagtttagaagagacccttatttttcrtatgcttaggaatatccagcaagccacttttaaaggctttttatcacattttattcttaagctttctgaattccttattatattttgcctgataaatagt

SEQ ID NO: 32195 - DNA, 201 bp, Homo sapiens
acccctgccagaaataaagggattaatctctttttgcttggcatagggagaagacagtgtctgctgatgtgcttaacttttttttttttttggtcaggtgygtaggtatgtgactgaaacccatagactttgcacatattgtcaaatgactttccagagggactcaggcactttatttaattaatgccaatgaagcccgtt

SEQ ID NO: 32196 - DNA, 201 bp, Homo sapiens
agttaccttctgtttgtaaacatctgtttggaaacgtttgctggtgcccaccccagcacccccccacccctgccagaaataaagggattaatctctttttscttggcatagggagaagacagtgtctgctgatgtgcttaacttttttttttttttggtcaggtgtgtaggtatgtgactgaaacccatagactttgcaca

SEQ ID NO: 32197 - DNA, 201 bp, Homo sapiens
caggaaagacaatgcagctttgtgttttggtttttatcagttaccttctgtttgtaaacatctgtttggaaacgtttgctggtgcccaccccagcaccccyccacccctgccagaaataaagggattaatctctttttgcttggcatagggagaagacagtgtctgctgatgtgcttaacttttttttttttttggtcagg

SEQ ID NO: 32198 - DNA, 201 bp, Homo sapiens
ttgcaccttttaattgctggatgttttccagaaaggctgtttgcagtagttccagtgggttcatctgtgaatcaggaaagacaatgcagctttgtgttttkgtttttatcagttaccttctgtttgtaaacatctgtttggaaacgtttgctggtgcccaccccagcacccccccacccctgccagaaataaagggattaa

SEQ ID NO: 32199 - DNA, 201 bp, Homo sapiens
ttcctcatgctttctctctttccagacaataaactttattttcttcataagaattcagtctacgcaagggtattaggcagcttgtttgcaccttttaattsctggatgttttccagaaaggctgtttgcagtagttccagtgggttcatctgtgaatcaggaaagacaatgcagctttgtgttttggtttttatcagttac

SEQ ID NO: 32200 - DNA, 201 bp, Homo sapiens
tggcgttcgctttacccttgcccttgatgtggtgccgagttgtcaggattctcgtaaaattcctgggtgatggcttcttctgttctctttatttccttaastgaacatctgtctaattgttcacctccatcgctttagtgctttcctcatgctttctctctttccagacaataaactttattttcttcataagaattcagt

SEQ ID NO: 32201 - DNA, 201 bp, Homo sapiens
tgcatgagtctttattttatgtccttggagtgtatagcagagttagatagatctttctggattggcggttgattgaatattggctgtacaaagaaactggwtaggagtatagagaaaagatcaatcatagcactagcttatagtttattttattctttaatgattttttaaaaatatttctctcacttacttgaaaagcag

SEQ ID NO: 32202 - DNA, 201 bp, Homo sapiens
gcattccacatacagcagtacctataatgtatatgcttcttaaagaatgcatgagtctttattttatgtccttggagtgtatagcagagttagatagatcyttctggattggcggttgattgaatattggctgtacaaagaaactggttaggagtatagagaaaagatcaatcatagcactagcttatagtttattttatt

SEQ ID NO: 32203 - DNA, 201 bp, Homo sapiens
gtcagcgagacagtagagagtggtggagatggtggcgcacaagagggtcagtgccccatctcaaggaacagctgcacctcggcctacgcgattgtgaaaaygtgagcatatgcaggccagaccttggcttctctgtcttcatttttcacaggagccagaagtttggatgtgcaatgtgaaatctcacaaattaaacatgtt

SEQ ID NO: 32204 - DNA, 201 bp, Homo sapiens
tttgtttttcttcaaacctagatcaagagtcaaacactcaaatgtttggtgggagcagttgatgatccagagctttggagtcagcgagacagtagagagtsgtggagatggtggcgcacaagagggtcagtgccccatctcaaggaacagctgcacctcggcctacgcgattgtgaaaatgtgagcatatgcaggccagac

SEQ ID NO: 32205 - DNA, 201 bp, Homo sapiens
aaagaggaagggttggaggagacaaaaaatggagtggtagtggcattgggaggtccaagagtggatggtatcacagaagccaagacaggaaagtgagccasaagtgagggaggagcaggatcctctgcaacagggcagtctagtcttagcagagaggaggttgctgaatttattgattgagaagccactcctcgccaggca

SEQ ID NO: 32206 - DNA, 201 bp, Homo sapiens
tgcaggtgtcatggatgaaacagcaatgccttgcggtgacaaattcagtgtagaaataattttagcaagcccagtgattggaaaacaatgactcaactttragctatattgattttgtatttctgggctcagcttttgactcagtctcattccccagaaataatccctgttaacatttcggtttgtgttatggaagtgttt

SEQ ID NO: 32207 - DNA, 201 bp, Homo sapiens
gccttgccataccttttcccatttatccatggattggtatgagccctaatggtgcacccttccgacaatccttcatccttcccagacgtttcatcagccargtgaaatttgcaattgtttcagtgattgaaattatgcttggagtgcaggtgtcatggatgaaacagcaatgccttgcggtgacaaattcagtgtagaaat

SEQ ID NO: 32208 - DNA, 201 bp, Homo sapiens
gccaggaggaggtcctagtcagctgatgtgagattacatggccctgactgtcttgcctggtgctgcaggccaccttcacagccttgccataccttttcccrtttatccatggattggtatgagccctaatggtgcacccttccgacaatccttcatccttcccagacgtttcatcagccaagtgaaatttgcaattgtttc

SEQ ID NO: 32209 - DNA, 201 bp, Homo sapiens
caaggtgccggcacagttgatgtcttctgaggtctccctcgtctgcttgcagacagccgccttcccaccgtgttctcacgtgacctagccgctgtgtgcaygcatccctggtttcttttcctgtgttcagatgtcctcttctttgaaggacaccactcagattgcaataggacctgccctgatagcctcattttttacata

SEQ ID NO: 32210 - DNA, 201 bp, Homo sapiens
gaaagctcgcctgaaaggccaagagtaagattcttttaaaatcatgcccaagttttaaaggaatataaaactttctctttaaaaatatacctttctgcttycatcccctaacccacaaagctcaagtctagtttaattcaaacttggaaatagttcttttattattgctccctgcaatgggaacagagctgaggctcctaa

SEQ ID NO: 32211 - DNA, 201 bp, Homo sapiens
tccactttccttaatgttccttaaatgttgtacatatcttaaaagtggattcctcataaaacaatatggactatggtcttattctgtttaacggtatgaargctcgcctgaaaggccaagagtaagattcttttaaaatcatgcccaagttttaaaggaatataaaactttctctttaaaaatatacctttctgctttcat

SEQ ID NO: 32212 - DNA, 201 bp, Homo sapiens
cctactgggttcaagcgattttcctgcctcagtctcttgagtagctggtgttacagaagcctgctaccatgcctggctaatttttgtgttgttttattttwattttatttttttagcagagacagggtttcaccatgttgaccaggctggtttcaactcctgacctcaggtgatctgcctgcctcggcctcccaaagtgct

SEQ ID NO: 32213 - DNA, 201 bp, Homo sapiens
atatgtgactatgatgagtaatgattttgaacatgaaaactatgcttattgctcatatctatgttattttattatttactttttttgagatggagtctcgytctgttgcccagtctggagagcagtggtgtgatcttggtttactgcaacctctgcctactgggttcaagcgattttcctgcctcagtctcttgagtagct

SEQ ID NO: 32214 - DNA, 201 bp, Homo sapiens
agtgtttaaggatccacttcctctacatccttaataatacttgatattatcggtcttctaaattttctgtttgggtacatagtggtattttgttgtatatwtttttttaattgtgaaatatgtgactatgatgagtaatgattttgaacatgaaaactatgcttattgctcatatctatgttattttattatttacttttt

SEQ ID NO: 32215 - DNA, 201 bp, Homo sapiens
gtggcttactcattgtcattggtgagtagtactccattgtgtggagaaatcacattgttttaaaaatacctaattacctgctgatagacatttgggttctkcccagtttttagctgttgtaaatggatactaatgtgaacgaagccaccgtgaatattgatgcactagtctttgtgtggacatatatctgttttatcttgg

SEQ ID NO: 32216 - DNA, 201 bp, Homo sapiens
cagtggcttactcattgtcattggtgagtagtactccattgtgtggagaaatcacattgttttaaaaatacctaattacctgctgatagacatttgggttsttcccagtttttagctgttgtaaatggatactaatgtgaacgaagccaccgtgaatattgatgcactagtctttgtgtggacatatatctgttttatctt

SEQ ID NO: 32217 - DNA, 201 bp, Homo sapiens
agcacatgcttcttgtagagtctgcagaatcggagccaattaaatctcttttcattataaattatccagcctcagttacttctttattgcagtgcaagaayagcttaacacacaaggtcttacccttgatcacggtctgcagcatgtcttttaccatgtaaggtaatatgttcagtggctgtgggggttaggatgtggact

SEQ ID NO: 32218 - DNA, 201 bp, Homo sapiens
tacctagattatctagcatgagctccctgtctcaaggtgatagagtttgcatgtttttctcctgcacatgccatgttgaaacataatccctagtgttggcrgtgggtgtgctgggaggtatttggatcatgggggtggaaccctcatgcatgacttacggccatccctttggtgataagtgagttcacatgatatctggca

SEQ ID NO: 32219 - DNA, 201 bp, Homo sapiens
gagtaagactccatctcagaaaaaaaaaaaaagaattaatatcaattttccacaaactcttttaaaaaaacagaagaggaggaaacactttccatctgacwctgtgaagccactattactctgacaacagaggcagacaaagatatcacaagaaaaggaaactttaggtcactttcacttataaatagagatgcaacaatt

SEQ ID NO: 32220 - DNA, 201 bp, Homo sapiens
ccggctccttcctcccacatcaccccacatttttttttctttctcctcaccatcaagaaatgttccagaatgccattattcttcgtcaccacggtcaggtrtatcatcctaagggcagagggtgaaggtgcgtaattagtgtttcaccagactgagcatcatcctcggtgcaggggagaatggctggtatttatgagtgaa

SEQ ID NO: 32221 - DNA, 201 bp, Homo sapiens
gacgatgacccttggttggagcaatgtagtctaaatgtggttgcatcatcttctttcttcctttgccttcctcccttgctctttttctgcccctcatgcckgctccttcctcccacatcaccccacatttttttttctttctcctcaccatcaagaaatgttccagaatgccattattcttcgtcaccacggtcaggtata

SEQ ID NO: 32222 - DNA, 201 bp, Homo sapiens
tgctgagaaatgatgatggtgacaatgatgacaatgacgatgacccttggttggagcaatgtagtctaaatgtggttgcatcatcttctttcttcctttgycttcctcccttgctctttttctgcccctcatgccggctccttcctcccacatcaccccacatttttttttctttctcctcaccatcaagaaatgttccag

SEQ ID NO: 32223 - DNA, 201 bp, Homo sapiens
taaaggagtgacttgctctcagttctttgtcattcagctgctttaatattaatatgacacccgttttgggcttgaaaagttttccttctgctgagaaatgrtgatggtgacaatgatgacaatgacgatgacccttggttggagcaatgtagtctaaatgtggttgcatcatcttctttcttcctttgccttcctcccttg

SEQ ID NO: 32224 - DNA, 201 bp, Homo sapiens
atgacctttggttcctaaactggtggacataccaaggactaaaggagtgacttgctctcagttctttgtcattcagctgctttaatattaatatgacaccmgttttgggcttgaaaagttttccttctgctgagaaatgatgatggtgacaatgatgacaatgacgatgacccttggttggagcaatgtagtctaaatgtg

SEQ ID NO: 32225 - DNA, 201 bp, Homo sapiens
atgcacccggctagggacctctttaatggtcattcatttgggagatgacctttggttcctaaactggtggacataccaaggactaaaggagtgacttgctstcagttctttgtcattcagctgctttaatattaatatgacacccgttttgggcttgaaaagttttccttctgctgagaaatgatgatggtgacaatgatg

SEQ ID NO: 32226 - DNA, 201 bp, Homo sapiens
gtatcctgctgggctgagtggggagggattctcaagctgtacatagctgacacacaggtttctaaaaggttgtctttcacccccattttcagaagtaccasgttccacattttctgagcctttgctggctctctgataggaattgtgttacttctcagctgtccccatggctagcttaagactcagctctcttaagtcact

SEQ ID NO: 32227 - DNA, 201 bp, Homo sapiens
tgataataaacttctgtcatttttctggagttatgaaatgatggtatcctgctgggctgagtggggagggattctcaagctgtacatagctgacacacagstttctaaaaggttgtctttcacccccattttcagaagtaccaggttccacattttctgagcctttgctggctctctgataggaattgtgttacttctcag

SEQ ID NO: 32228 - DNA, 201 bp, Homo sapiens
ttatgttctcttctgataataaacttctgtcatttttctggagttatgaaatgatggtatcctgctgggctgagtggggagggattctcaagctgtacatrgctgacacacaggtttctaaaaggttgtctttcacccccattttcagaagtaccaggttccacattttctgagcctttgctggctctctgataggaattg

SEQ ID NO: 32229 - DNA, 201 bp, Homo sapiens
ggtaaacatttacaaagtctgtgttttcagtatcatgccactgttctcacctgtttatgttctcttctgataataaacttctgtcatttttctggagttakgaaatgatggtatcctgctgggctgagtggggagggattctcaagctgtacatagctgacacacaggtttctaaaaggttgtctttcacccccattttca

SEQ ID NO: 32230 - DNA, 201 bp, Homo sapiens
ctgtggactcctctgaaggatgatctggctggactattttttgggaaaaccactgtgtttgaatgtttgcatgtgtcctgttggcagaacaaatatcccasagaaggatcttcttatcttctgcttggggaaggtgtagctctgactgctagagttctagagccaagtgagggggagagttctgagtctctgcattcagta

SEQ ID NO: 32231 - DNA, 201 bp, Homo sapiens
aactgtggactcctctgaaggatgatctggctggactattttttgggaaaaccactgtgtttgaatgtttgcatgtgtcctgttggcagaacaaatatccyacagaaggatcttcttatcttctgcttggggaaggtgtagctctgactgctagagttctagagccaagtgagggggagagttctgagtctctgcattcag

SEQ ID NO: 32232 - DNA, 201 bp, Homo sapiens
tagtgtttcaccagactgagcatcatcctcggtgcaggggagaatggctggtatttatgagtgaatggcagcgttttgacaggatgatgaataaatatgcygggcccagaggactccaggtgataagcatttctttgtggtctggtaagtgatagcacccattgcttaatttctctaaaatctgcatttgtcaattttgta

SEQ ID NO: 32233 - DNA, 201 bp, Homo sapiens
cctcaccatcaagaaatgttccagaatgccattattcttcgtcaccacggtcaggtatatcatcctaagggcagagggtgaaggtgcgtaattagtgtttsaccagactgagcatcatcctcggtgcaggggagaatggctggtatttatgagtgaatggcagcgttttgacaggatgatgaataaatatgctgggcccag

SEQ ID NO: 32234 - DNA, 201 bp, Homo sapiens
ttttttttctttctcctcaccatcaagaaatgttccagaatgccattattcttcgtcaccacggtcaggtatatcatcctaagggcagagggtgaaggtgmgtaattagtgtttcaccagactgagcatcatcctcggtgcaggggagaatggctggtatttatgagtgaatggcagcgttttgacaggatgatgaataaa

SEQ ID NO: 32235 - DNA, 201 bp, Homo sapiens
gacctccccaaagtgtttccttcccgtggcctcttctcccgatcagctgtttgttatctgagggattcgttaataaccaggacatctgattctcatcattrctcatcctctgctcactctcctttctaatgcataggcctttagccttttactttctacctttttgaatgctatacttttttgtaaaattttaattaggtt

SEQ ID NO: 32236 - DNA, 201 bp, Homo sapiens
catgcccagctaattgtgtatttttagtagagacgggatttctgcatgttggtcaggctggcctcaaactcccgacctgagatgattcacttggccttggmctcccaaagtgctgggattacaggtgtgagccaccgtgcccggccagacccgtgctctttctcccaccactgccctgtgccaaccaccacccccactcct

SEQ ID NO: 32237 - DNA, 201 bp, Homo sapiens
tgcatcttataagaaggacagtgcttaaaacagaaagaattgagtagaaattaagacatagcttgatttttttccaacagaatcatgaagtctgttcaatyttctttttaaaaagtaatttaatcttctagaagatatctacgtttattcaataatttcctaaggtagtcttcaaaacctaggagcctaggagatacatgg

SEQ ID NO: 32238 - DNA, 201 bp, Homo sapiens
cctgattacctacatttattaatgaaaacaaccaagaatagttgagcccaaaagtacaaatcaatgtgctgaatcagtttatgatgtctccctaatttctscacatctgttgagctgtgatttcaaattccattccatttcttttcttttcttttcttttttttttttttggagacagtgtcttgctctgtcacccagcct

SEQ ID NO: 32239 - DNA, 201 bp, Homo sapiens
gcctcagtaactgttagctctcttattgctaccggacaagtgttcttattttcccttttcttcttcttccttttcctgttccttgcccttcctctttcgawgaaagtttacgccaaaaaggatgagctgggttgcagccagcattctggtttcacaggagcctaggagatacatggagaatattctgaggctaggttaaat

SEQ ID NO: 32240 - DNA, 201 bp, Homo sapiens
aggtgattgaatcatggagaccgttcccccgtgctgtgagtgagttctcatgagatctgatggttttgtgcggggcttttccccactttgctctgtacttstctgtttcttctccttcttgccaccaggtgaggaaggacatatttgcttctccttccatcatgaatgtaagttttctgaggcctctgcagccctgtagaa

SEQ ID NO: 32241 - DNA, 201 bp, Homo sapiens
tgtaggcctaattctagcaatctcagcaactgtaggatttctctgcattggaggaagcaagactgaaggtcgtctggctttatggacaatgtgcttagaarttcatgccataccttaggtccagtcttgtgactgaaccaaccagacaggcctaggctctgccctaagtggtcagcctccgaggtggtagcacgcagggcc

SEQ ID NO: 32242 - DNA, 201 bp, Homo sapiens
atcccccacagctttgggtggagaatttggaaaaaatgccttaagtctgccatttgtagaaccatattaagtagtgatttccatttgatgccaaaaaaatwtgccatttagtttcttcctaagaggcaatctgacaatttcgagtagactgctggagtctgacaaatttgaatgtattatggactgaataaatgtttattg

SEQ ID NO: 32243 - DNA, 201 bp, Homo sapiens
tgttagagcagagagagtggcgaggattaatctagactgaaatgtgctaatcaagctgtctcagatgccattttctggatagggaggaacagcagttggcragtttaagagcaatatggaggaaccactggggattctatgcatgatcttaggggaagtagcattattatctccaacactggctgtttacattatcagaat

SEQ ID NO: 32244 - DNA, 201 bp, Homo sapiens
agaattgcttgaaccctggtaggcagaggttgcagtgagccgatgtcatatcactgcactctagcctgggcgacagagtgagactctgtctcagaaaaaamaaaaaaaaaaaaaaaaaaaaaaaaaggctttcctgaaaggtgattcacaggcctcttcggatcccttcgtgtttagcaatttggatttccacacagcctt

SEQ ID NO: 32245 - DNA, 201 bp, Homo sapiens
tctgagcgggaactgggcaattggaggttctttcccctcccgtgctggtgggagaattgtttagtaggtcataaagtggaatctccattccagtctgatcyggtcaattctggtaggacttcatccaagcacaaagaaacctttgttttcattcaagacttccctaaaaggtggctgggtgcggtgcctcaggcctgtaat

SEQ ID NO: 32246 - DNA, 201 bp, Homo sapiens
cccacatgcagtatttctatggtccaaataagtatctgtcggacttagaatatttaaattaggatttagttgaaagattatgttctatatctttttttttwaaaaaaaaggaagaaaaataaagctcttcctaaatttatttacatgttggagcaattctggcactgctaaataaggcaggaaattccattaagtttaaat

SEQ ID NO: 32247 - DNA, 201 bp, Homo sapiens
gcctaacaactgaacacattttatgaaatttgcaaatctgtttccaaacatgtttgaatggatttttatggtcttttaattaacccaataaaaatggtaasaacacagcaattttaagaaaataacagagccaagtattttttatagctatgcatgcaatccacattacacccacatgcagtatttctatggtccaaataa

SEQ ID NO: 32248 - DNA, 201 bp, Homo sapiens
atttccaaggccaccagggagcagggaaagtcaccaaaagaccgctccttgaaaccaggcaagaagccatctttgcagtgagctgagaggtctgatggccrccagctgagggagggaattccccttttgtgccttcgggattgatagagaagcccagtggacttagcatctgggaatcccagattgatcttttctggatat

SEQ ID NO: 32249 - DNA, 201 bp, Homo sapiens
acttttaaggacccttgtcatttcattggtctcagctggatagctatcaagggtcactttaaggtcagctgactagcaaacctaattctatctgcaacctkaattcatataacctggcgtagtctcgattttattttaattttttaattgaattcagctttacagtatcttttgtagggggtaattttagcttctttctcc

SEQ ID NO: 32250 - DNA, 201 bp, Homo sapiens
tatttcggtctgaaaccgctgtttggatagttttagaagttgaccatgaaaattgccttctggttgtaacttggatccccaggtttcaatctgtgggctamcgtttcttgggattttcagaaaggattggcttggctttttatcaaagttacacaacggctgtaaaaaataaataaaaaaaaagcaaaattagcactttat

SEQ ID NO: 32251 - DNA, 201 bp, Homo sapiens
cggtcaccttccagccagcaacattgggctgactccttcaatggccatgtctctggttctttgtcttttgcctcctcctcttacttttaaggacccttgtsatttcattggtctcagctggatagctatcaagggtcactttaaggtcagctgactagcaaacctaattctatctgcaaccttaattcatataacctggcg

SEQ ID NO: 32252 - DNA, 201 bp, Homo sapiens
gccaggctgaaatggagtggaaggcagccctggctggaagtcttgctgggaacctggagcgctgggaggtaaaactttacttggtgctggcagcgtcactwtgccagtctgtttcttcccgagcttcaggccatgctgatgttcaagttgaataaatgagagctaatgattttttaaggcgtttttagtgaattgccgtgg

SEQ ID NO: 32253 - DNA, 201 bp, Homo sapiens
agcatcatctttaactagacatcaacctggttttgaatcctttgagttttggcaaatagaaaattcatccagggccacaaaaaatatctataattttgacscagttgtagtctagagagatacttagttcaaaaagaattgtgttatcgtcatcaagcaaaacaacagtatatgctatcatctctgagatgtcacacgatt

SEQ ID NO: 32254 - DNA, 201 bp, Homo sapiens
gagagatggggagtaggagaagaaaagccaaaggcagactttagtctggtttataatgctttaatatttttttgaaggaagaaaaatgttcattacttaaygtaataattatttttaaaaagcagcctggggggggggtattcatttttctgtggctgccataacaaagttcttcaaacttagtgtcttgagacaagacat

SEQ ID NO: 32255 - DNA, 201 bp, Homo sapiens
acgggacaagcttatggtaggtctgacctcagcattcagaaaaacaatgtgaaatttgtaatatgtgtcagaactggcaatcaacgccataaggacaataraataaaatacatttctccactttagtaaatgaggcttcatgcttcctatggcataacttttttgttgttgttgttttttcttttctttgaaacggtttta

SEQ ID NO: 32256 - DNA, 201 bp, Homo sapiens
aggcaggaggatcacttgagcccagaagttcaacattatagtgagccactgtactccagctgggtaacagagtgagaccctgtctctgaaaaataaaaatwaaaaaaaaaattaagttagaagggagggattacgaccctcatgtgtatcaagaaacaagctccatgaagccccgtaggatggctcagcaccagaacgagg

SEQ ID NO: 32257 - DNA, 201 bp, Homo sapiens
gaggcaggaggatcacttgagcccagaagttcaacattatagtgagccactgtactccagctgggtaacagagtgagaccctgtctctgaaaaataaaaayaaaaaaaaaaattaagttagaagggagggattacgaccctcatgtgtatcaagaaacaagctccatgaagccccgtaggatggctcagcaccagaacgag

SEQ ID NO: 32258 - DNA, 201 bp, Homo sapiens
aaatgtgttgtttgagatgaaccatcgtttcaaatgtcacttacttcttgttttataaagtatcattactcttttcttggacacagtctcatctttgaggwgtttgcagattttatctcctgtggacatttctacaaaatcaatcaacaaacttgagcagagaaatcatcatactagccacacacactctgcaggcattaa

SEQ ID NO: 32259 - DNA, 201 bp, Homo sapiens
caacaccttaagtgctggctttctgaacctcttgcccacctaggcatgcctgctactttgaagtggcaagagttatctttgtctattacatcagcattccyaaacttacatgttaacataaacatggagctcagaggaaatgtgttgtttgagatgaaccatcgtttcaaatgtcacttacttcttgttttataaagtatc

SEQ ID NO: 32260 - DNA, 201 bp, Homo sapiens; identical to SEQ ID NO: 8676

SEQ ID NO: 32261 - DNA, 201 bp, Homo sapiens; identical to SEQ ID NO: 8677

SEQ ID NO: 32262 - DNA, 201 bp, Homo sapiens; identical to SEQ ID NO: 8678

SEQ ID NO: 32263 - DNA, 201 bp, Homo sapiens; identical to SEQ ID NO: 8679

SEQ ID NO: 32264 - DNA, 201 bp, Homo sapiens; identical to SEQ ID NO: 8680

SEQ ID NO: 32265 - DNA, 201 bp, Homo sapiens; identical to SEQ ID NO: 8681

SEQ ID NO: 32266 - DNA, 201 bp, Homo sapiens; identical to SEQ ID NO: 8682

SEQ ID NO: 32267 - DNA, 201 bp, Homo sapiens; identical to SEQ ID NO: 8683

SEQ ID NO: 32268 - DNA, 201 bp, Homo sapiens; identical to SEQ ID NO: 8684

SEQ ID NO: 32269 - DNA, 201 bp, Homo sapiens; identical to SEQ ID NO: 8685

SEQ ID NO: 32270 - DNA, 201 bp, Homo sapiens; identical to SEQ ID NO: 8686

SEQ ID NO: 32271 - DNA, 201 bp, Homo sapiens; identical to SEQ ID NO: 8687

SEQ ID NO: 32272 - DNA, 201 bp, Homo sapiens; identical to SEQ ID NO: 8688

SEQ ID NO: 32273 - DNA, 201 bp, Homo sapiens; identical to SEQ ID NO: 8689

SEQ ID NO: 32274 - DNA, 201 bp, Homo sapiens; identical to SEQ ID NO: 8690

SEQ ID NO: 32275 - DNA, 201 bp, Homo sapiens
tcctcctccttccccctccttccccctctctttttccttttctttctatcatcatccatagctctcttgccccattgttttaaacccatctgtttttgttkctggtaactgtatccaaaagtaatacagaattttccgtaagaacatttattgtgtttccttctacccacgaattttcttatgctacacacacaacccact

SEQ ID NO: 32276 - DNA, 201 bp, Homo sapiens
aaattaggttatatgcgtgaagttcgtagagccagggtctgggcattaatacgcatttagttactgtcgctcctgtgatctgcacaattattgtcattatyttcccttcctcctccttccccctccttccccctctctttttccttttctttctatcatcatccatagctctcttgccccattgttttaaacccatctgtt

SEQ ID NO: 32277 - DNA, 201 bp, Homo sapiens; identical to SEQ ID NO: 8691

SEQ ID NO: 32278 - DNA, 201 bp, Homo sapiens; identical to SEQ ID NO: 8692

SEQ ID NO: 32279 - DNA, 201 bp, Homo sapiens; identical to SEQ ID NO: 8693

SEQ ID NO: 32280 - DNA, 201 bp, Homo sapiens
gaatgctgttaataagagaaatgaaaggatgatgggagatgtgcacccagcaatgtctgtcttgtggtcctgaagtctaactctaatcctggctccactayctggaccatgacaggttgtttaattgttctagttagagtgttctcctatgtaaatagggataataattggatgtatggcaggatttgggggaggattaaa

SEQ ID NO: 32281 - DNA, 201 bp, Homo sapiens; identical to SEQ ID NO: 8694

SEQ ID NO: 32282 - DNA, 201 bp, Homo sapiens; identical to SEQ ID NO: 8695

SEQ ID NO: 32283 - DNA, 201 bp, Homo sapiens; identical to SEQ ID NO: 8696

SEQ ID NO: 32284 - DNA, 201 bp, Homo sapiens; identical to SEQ ID NO: 8697

SEQ ID NO: 32285 - DNA, 201 bp, Homo sapiens
tgtaaccaattaccaatctgaaaatccttgaatccacctgatatggtttggctgcatccccaccccaaatctcatcttgaattgtaatccccacaatcccsacatgtcaagggagagaccaggtggatgtaattgaatcatatactcccgatagtgagttctcacgtgatccgatggttataaataagtgtttggtagttt

SEQ ID NO: 32286 - DNA, 201 bp, Homo sapiens
attccctgtaaattttgctccttcccacaaccccagtgagccccactctgtcccataattccctgtaaatctcactccttcccacaatccccactgagtcscattccttcccacaattccctgtaaatctcactccttcccacaatccccactgagccccactccttcccacaattcccagtgaaccccacttgtgtagtg

SEQ ID NO: 32287 - DNA, 201 bp, Homo sapiens
aatgtctgcagggtaagcacactgttttgcactccacacaattcacttcacaatatttcatagagactttttcatattaatatataaagagatatatacgygtgctgcttcacgataatccattgcagagctggtctgtaatttattcaagcattctttgttgatggatgttagggttgtatccattattttgctattatg

SEQ ID NO: 32288 - DNA, 201 bp, Homo sapiens
tcctccaaatatgatacacaaattgccaatgaatacataaaagatgttcaatctcattagggaaatgcaaatgaaagccacaatgagattccacttattgmtaggatggctaaaataaaaaagtcagataacaaatacttacaaacacatggagagatgaaagttcaaatacagtcctggcggaaatgtaaaattgtatgg

SEQ ID NO: 32289 - DNA, 201 bp, Homo sapiens
tgcatagtattctatcatatggatatattctaaatgtaataattcctcaatggtatatttagtttactttatatttgctgctttagtttgtcacaaacacygtggatagccttgtatatatttattttgttgtatagttcttattggtacagtatgatttttcacaagtatacaattactttctgagaatttagctttttg

SEQ ID NO: 32290 - DNA, 201 bp, Homo sapiens
cagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggctt

SEQ ID NO: 32291 - DNA, 201 bp, Homo sapiens
attatcaaaacccaagtctttgtctcactcacggtccacaccccgcccagagtcgtatcacttgactgcatttgaccattcagttttcagaccaactccawtgttactagatatcctgacactgaagaagctaaaaccaaacaacaatgacaacaacaaacccaagtctgccttatggcacattcttcacgtcgtaacacc

SEQ ID NO: 32292 - DNA, 201 bp, Homo sapiens
attaagttcaagtcatgtcagttattcaaattcaggaccagtggaacttgtccagtatcatcaagcagccagttattatcaaaacccaagtctttgtctcrctcacggtccacaccccgcccagagtcgtatcacttgactgcatttgaccattcagttttcagaccaactccattgttactagatatcctgacactgaag

SEQ ID NO: 32293 - DNA, 201 bp, Homo sapiens
ggggaacccatagctccagccagtgtttgtatgtcaaggtattattatttatcacaatggatcagtaagcattgatgacaactggcaaggtattgcttcaratattttataacggagttgttaacattatttcctttagatggctctttcatcttttctgcattatgaactgatgccccaaaaggtggtatgaatgaaagt

SEQ ID NO: 32294 - DNA, 201 bp, Homo sapiens
cgttcctgcaaatatttcacagaggagtaagagccacattcttgctggctttccaattcattctcctctcttcgagtccacctcttaaaacttcttagtgmtcttgcaagaaactcatgtcttttgtcagggagaatggcatggcctttgtatgacacttccttctagccagactcggatttgggggcatcatatttggga

SEQ ID NO: 32295 - DNA, 201 bp, Homo sapiens; identical to SEQ ID NO: 4909

SEQ ID NO: 32296 - DNA, 201 bp, Homo sapiens
tgtgtgcccaggaaatggccaaatgttatcactcatccttccaagaaccacatgaaggttatattattatgtcgactttccagatgaggagactgaggctyagtggcttgtcataggtgtcaaagacaggagtccaatgtaaggacttctggcttcagcacaggggattttcctaccatcccatattgccaccccatctgc

SEQ ID NO: 32297 - DNA, 201 bp, Homo sapiens
cctcccaaagtgttgagatcacaggtgtgagccatggtgccaggcctctcctgtctttaactggggataatgtgtgcagaattccccctaaaggatctatsatgcgtaaggtggaccctcacagaaagcgtcaaagacacacgaatctcttagcaggaggccgccaggtggcacaaaatcaaaactgcatcattgagaatt

SEQ ID NO: 32298 - DNA, 201 bp, Homo sapiens
agctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatggg

SEQ ID NO: 32299 - DNA, 201 bp, Homo sapiens
agctcaaagggagcacaattccctggagagctagggaaataatgaagtctaaggtctggcagatctggatctgaatcctggcaatgcatttcgggagttcrgtgtcaccctgagcatctttcaattccttgaacttcagtctcctcatctctgaaatggggttattatctacctgcagaggtgctgcagtattaactgagg

SEQ ID NO: 32300 - DNA, 201 bp, Homo sapiens
gggggatctcagcagcacactacaatatccactacagtttcttgggcttgctctgaagccatgcctctctaacttcagggtatattcatgtaagtgaggtrcagggatgggggaaagggagaaggtaaagctacaaaggtaagccagcttgtctagaccgggagctagctccttgtgaaggaatggcaatgataatggtta

SEQ ID NO: 32301 - DNA, 201 bp, Homo sapiens
gttttactccttgtctcacattcctttctgctacttctctttggctcaccaaaaggagacagaagtttgtgtccatggctgtgaactgccaaagagttgcsaattctctacgatctttgacctctgtgatcccaggggcaaggccagcactttccattccattagacttcattctcttgtgggtgctttctgctggaatct

SEQ ID NO: 32302 - DNA, 201 bp, Homo sapiens
cgttttactccttgtctcacattcctttctgctacttctctttggctcaccaaaaggagacagaagtttgtgtccatggctgtgaactgccaaagagttgycaattctctacgatctttgacctctgtgatcccaggggcaaggccagcactttccattccattagacttcattctcttgtgggtgctttctgctggaatc

SEQ ID NO: 32303 - DNA, 201 bp, Homo sapiens
tggtctcgaactcctgagctcaggcagtctgcccgcctctgcctcccaaagtgctgggatcacaggcgtgagccaccgcgcccagcccatgacttctcttyatgggagagaaaggccaccgagatagtaagtggacatcaggacatggattctattaaatctaacacctttatctttgcatttccatacattttgcttatt

SEQ ID NO: 32304 - DNA, 201 bp, Homo sapiens
cagggtttcaccgtgttgcccaggctggtctcgaactcctgagctcaggcagtctgcccgcctctgcctcccaaagtgctgggatcacaggcgtgagccascgcgcccagcccatgacttctcttcatgggagagaaaggccaccgagatagtaagtggacatcaggacatggattctattaaatctaacacctttatctt

SEQ ID NO: 32305 - DNA, 201 bp, Homo sapiens
aggcacctgccaccacacctggctaattttttttgtattttagcagagacagggtttcaccgtgttgcccaggctggtctcgaactcctgagctcaggcartctgcccgcctctgcctcccaaagtgctgggatcacaggcgtgagccaccgcgcccagcccatgacttctcttcatgggagagaaaggccaccgagatag

SEQ ID NO: 32306 - DNA, 201 bp, Homo sapiens
gcctgcctcagcctctcacagtgctgggattacaggcgtgagccaccgtgcccggcctcatatccttttttatggaaaaaaaaaatcgggaattagcgtgyagctattaggcgtagattcctgcctaaggtctggatatgaattccaaagaccactggactttggaatattcgtaggtctctgaaaattcagacccacaga

SEQ ID NO: 32307 - DNA, 201 bp, Homo sapiens
gagctgagtgattttagtaggtagtttaactccttaaaaacttccagtggtttcatattctacctagttttaggtgacagctggtatggggtggggaaggrgggggggataaagatattaatttggaagcatttgattgctccattattttatcatcttcccatggaaatgttttcataacgcgttgttttttaattatta

SEQ ID NO: 32308 - DNA, 201 bp, Homo sapiens
ggagctgagtgattttagtaggtagtttaactccttaaaaacttccagtggtttcatattctacctagttttaggtgacagctggtatggggtggggaagsggggggggataaagatattaatttggaagcatttgattgctccattattttatcatcttcccatggaaatgttttcataacgcgttgttttttaattatt

SEQ ID NO: 32309 - DNA, 201 bp, Homo sapiens
acaaaaagttaaatcatctgccctaggtcccagagctggaatttgaaccaaaggttctgtgcctcccaaatttgtattcttatctctgcatcacactaacwctgtcactcagtccttttctcactgctctggtctctatacttagagcttcgagacctgccactcagatgactccagaagaaaacacgctttggtgtcgtg

SEQ ID NO: 32310 - DNA, 201 bp, Homo sapiens
atttaatacccattacctacggaggtggtttctactattgcacccactctacagatgagaaaatggaggcacaaaaagttaaatcatctgccctaggtccsagagctggaatttgaaccaaaggttctgtgcctcccaaatttgtattcttatctctgcatcacactaacactgtcactcagtccttttctcactgctctg

SEQ ID NO: 32311 - DNA, 201 bp, Homo sapiens
gctgtgagtaaatcagtgtgttccttatacttaataacatactaagtggcaataataattattataacaaatgtatcaaataactatgtgtgaactctgcrtgtttcagcccatttaatacccattacctacggaggtggtttctactattgcacccactctacagatgagaaaatggaggcacaaaaagttaaatcatct

SEQ ID NO: 32312 - DNA, 201 bp, Homo sapiens
aaaagcttaggctcaaagagattaaatgtcttatttctgcttttggaagatacacattttatttttttctgtgtctctgaattggcatccaaccataatcrttgtgctaatttactgtattcttactctccctctccagtgctgtgagtaaatcagtgtgttccttatacttaataacatactaagtggcaataataatta

SEQ ID NO: 32313 - DNA, 201 bp, Homo sapiens
taaataagtcaaacaatatgaatatataagaagaaaacgctcgtaatttatgctctacctcttccctttgctaagtggcaattttggaccttctgtgaccrtgcaaacatgcagattatacatgcactataggagtggaatgtatgtgacttaatagcgtaatattttgtccattattttaaaacttgctttatttggtca

SEQ ID NO: 32314 - DNA, 201 bp, Homo sapiens
ttagcaaatcacgccttattcctaggcagacttcttgggtacactttccaccctccccagcagtaatgcctgaccaactaatggaatcctaactaatgcartatgtgacgcctggcagctccagtccgaaccaagggaaaacctgcaaacatgcaatccttcatgcttttgtttttgtttttccttcagcctagctaaaat

SEQ ID NO: 32315 - DNA, 201 bp, Homo sapiens
tccaaaagtgtagcattaaactcagagatgtaaaacaacgtgtctaaatgccaggtaagcaatgcttacttgacttggaccagggtggtgaatgaacatamaaaccgattacaacatttttccatttttatgtttcctctgaaaccagccatgagaggtactcttagcaaatcacgccttattcctaggcagacttcttgg

SEQ ID NO: 32316 - DNA, 201 bp, Homo sapiens
aacccactttatttggactaaggtttctcaatgtgtgttcagttctggctcatgcttggcacttacatttgagccatattcagtagtcccagccttacttrttcttttacaaaaagggtcagcagactttctgaaaagggacagatagtaaatattttaggctttgtggaccatagggcctgtgtcaaaagtactaaatgt

SEQ ID NO: 32317 - DNA, 201 bp, Homo sapiens
ttgcttttattaggtgggcataattgcattcatgggatcacctacaaagtcctttcgaatataaaattgaaatggcttcacactcagtgcacaagtccttmtgaggcactgttttccccttcgctgcctccggttccccttttgctgtgaagttcacattgaagtgtgaaaagagagacgtggcaactgacacatgctgga

SEQ ID NO: 32318 - DNA, 201 bp, Homo sapiens
ctttaggagtgtgtttttgccctccctcggaatctggtgatctcactaccaatggcaaagacaaactgtgaggtgtttttttgtttgtgtgcacgcgcacrtatgtgtgtgtgtaaaaaggccatggaaatataaaattgtaacctaaatgccttcacggccagttatggtggctcacgcctgtaattccagcactctggg

SEQ ID NO: 32319 - DNA, 201 bp, Homo sapiens
tcaatgagtttcataccctaaattatgccagattaagaaaatgaaatctgactgtaaattacttctctaggagcaaatgattgcttgattctattgtagamaataaaaattttttacttaaaccacacaaattaaaaaatggaactcactttcacagtcaagagttacttctatttttttttacagtaaatgcgctcttta

SEQ ID NO: 32320 - DNA, 201 bp, Homo sapiens
acagcgggcttgatgggcccagaaatcaagatggaaaaaaacaaccctctatgttgatggccatgcacagtggctcagcagaactggctctgttgaccagkcttgggtgctctcctgcagggcattgcaatctttaggacaccttcattacccctcctaaaaggagattttataatgagcgccaaccagctcaaacaagtt

SEQ ID NO: 32321 - DNA, 201 bp, Homo sapiens
gggcttttccaggccttaatttctctgacacaggaggatggaattacattatttccaccacaaagattgtgttttaaatccttcttagtttgcagcttttyttcccttttgcctcctctttagttcattccaatgataaatcctccctcctttgtcacagagccactgtgtactttcatagaccatcctatttttcaacga

SEQ ID NO: 32322 - DNA, 201 bp, Homo sapiens
cctctgcagggtgtctgtgggcatggtttgcaaataaacagtgagaagtataagctaaacatagactttaggcatatacataataggcaggcgtgatcgcrttcacccattcagtttgccatataaaagcttttcctcggtgccactttatggcccagaaacaaggctacaaaaactttaatactgctttttattttatag

SEQ ID NO: 32323 - DNA, 201 bp, Homo sapiens
ttgaggctgaggcaggagaatcactggaactgggaggcggaggttgcagtgagctgagatcgtgccattgcactctggcctggacaacgagcaaaactccmcctcaaaaaaaaaaaaagagagagagagaataaggtcagagggggaaaagagagaaagtgaaagcaacagtaaggaagagaattggaaaaaaaaaaaaaa

SEQ ID NO: 32324 - DNA, 201 bp, Homo sapiens
taaagatcaggccttgggagatgcaaacagtttgcccttggaccatgtcttctgctttcatccttatgctctcaacagatcatgccaaggtcctgtgttcmccgccttcctgagtccccattcagaggctcaagaattgagacaaaagggcatcctgcaaatttgctgccctggaagctgtgctgggggagccagtagaga

SEQ ID NO: 32325 - DNA, 201 bp, Homo sapiens
actggtgttcctctagtaggcaacattgatggtaaacatagaaagtcatggaaggcctcagttacctctagccctgaagacacagggatacccttggggcrgagaccttagggacaggacaataaagatcaggccttgggagatgcaaacagtttgcccttggaccatgtcttctgctttcatccttatgctctcaacaga

SEQ ID NO: 32326 - DNA, 201 bp, Homo sapiens
gccacgtgaggccgagaacatccaaatgaacactggtctgtttgttcaagatgggagctgtcagttgtgagagctcctatgggaagagtgttttgatgtayagacatccctggtccacagagccaccaagcaaggcagactatttcgtgagaaagaaggaagatagactccatgcaacacagtgggtgtggcaccaagcgg

SEQ ID NO: 32327 - DNA, 201 bp, Homo sapiens
ctctgaaaattacgaaagaaatagtgcatggattccagccccagtaggcttctgggcttggtgtttctttaatttcatgtaaatttctctaagtaaatatkccttaaaagtgaataaaattttatttcgctttaacaagagaatataaaagttaaaaaggtcactgtagtaatagactaatctcaattaccagggcagcct

SEQ ID NO: 32328 - DNA, 201 bp, Homo sapiens
acctgctatcctccccagctttgcacacctgattgctttttgtaagtcagatctcagattaattgtcgcctttacagacagatttttcttaactctccagwctaaagaagccacctcctccagttctcagcactgtgcttctcactctcgtttattttgttgtttattcatttgcttgtcatctgtattttcccactagaa

SEQ ID NO: 32329 - DNA, 201 bp, Homo sapiens
tgaaaagacagtttgtgagagttgtgatgattgtgatctgtgtcctttacagtttgcaagggaaggggacatgctatgtcagagtggagggacatggggasgcaccaggactggtcaagaggcagagggagagggtcaaaccgtgggttctgtggggaggactgaacgaggcagggtaagtagactagggtttgagtaagt

SEQ ID NO: 32330 - DNA, 201 bp, Homo sapiens
cctaacaggctgataatccatggatcgcattttgaatagaaaggattatgcaaaaagccagagtttttttttcccttgtcttataccagtggtgcctagcrtggtgtcaggtttatagaggactaatacatataagaaggagaaagggagggaggaggaattccagttgttttttttttaatctaggtacaagtctctctg

SEQ ID NO: 32331 - DNA, 201 bp, Homo sapiens
aattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggaggaattccagttgtttttttttt

SEQ ID NO: 32332 - DNA, 201 bp, Homo sapiens
aaaatattttagactttgaagtctaagagacaaaattgaggttattatgtaggtattcatatagcatttaaaatgtaatcattttaaaatgtagaaatcasttttagatcgtagaccataaaaaaacagcaggaaaaactacatggttggctggatttggccaagttgacatagagagccaatccctcatctccagcaggg

SEQ ID NO: 32333 - DNA, 201 bp, Homo sapiens
aagagatggaaaccattctggccaacatggtgaaaccccatctctcctaaaaatacaaaaattagctgggcatggtggcgtgtgcctgtagttccagctastcgggaggccgaggcaggagaatcacttgaaccagggaggaagaggttgcagtgagctgagatcacgccattgcactccagcctggcgacagagggagac

SEQ ID NO: 32334 - DNA, 201 bp, Homo sapiens
tcaagagatggaaaccattctggccaacatggtgaaaccccatctctcctaaaaatacaaaaattagctgggcatggtggcgtgtgcctgtagttccagcyactcgggaggccgaggcaggagaatcacttgaaccagggaggaagaggttgcagtgagctgagatcacgccattgcactccagcctggcgacagagggag

SEQ ID NO: 32335 - DNA, 201 bp, Homo sapiens
ttttgcttaagaaggcaagccgggaatggtggctcacgcctgtaatcccagcactttgggaggccgaggcaggcagatcatgaagtcaagagatggaaacyattctggccaacatggtgaaaccccatctctcctaaaaatacaaaaattagctgggcatggtggcgtgtgcctgtagttccagctactcgggaggccgag

SEQ ID NO: 32336 - DNA, 201 bp, Homo sapiens
ggcaagcttttgcttaagaaggcaagccgggaatggtggctcacgcctgtaatcccagcactttgggaggccgaggcaggcagatcatgaagtcaagagawggaaaccattctggccaacatggtgaaaccccatctctcctaaaaatacaaaaattagctgggcatggtggcgtgtgcctgtagttccagctactcggga

SEQ ID NO: 32337 - DNA, 201 bp, Homo sapiens
tggcaagcttttgcttaagaaggcaagccgggaatggtggctcacgcctgtaatcccagcactttgggaggccgaggcaggcagatcatgaagtcaagagrtggaaaccattctggccaacatggtgaaaccccatctctcctaaaaatacaaaaattagctgggcatggtggcgtgtgcctgtagttccagctactcggg

SEQ ID NO: 32338 - DNA, 201 bp, Homo sapiens
tagattcttctagattctacagcaggcactggcaagcttttgcttaagaaggcaagccgggaatggtggctcacgcctgtaatcccagcactttgggaggmcgaggcaggcagatcatgaagtcaagagatggaaaccattctggccaacatggtgaaaccccatctctcctaaaaatacaaaaattagctgggcatggtg

SEQ ID NO: 32339 - DNA, 201 bp, Homo sapiens
tctagattcttctagattctacagcaggcactggcaagcttttgcttaagaaggcaagccgggaatggtggctcacgcctgtaatcccagcactttgggasgccgaggcaggcagatcatgaagtcaagagatggaaaccattctggccaacatggtgaaaccccatctctcctaaaaatacaaaaattagctgggcatgg

SEQ ID NO: 32340 - DNA, 201 bp, Homo sapiens
acttagggttctagattcttctagattctacagcaggcactggcaagcttttgcttaagaaggcaagccgggaatggtggctcacgcctgtaatcccagcwctttgggaggccgaggcaggcagatcatgaagtcaagagatggaaaccattctggccaacatggtgaaaccccatctctcctaaaaatacaaaaattagc

SEQ ID NO: 32341 - DNA, 201 bp, Homo sapiens
ctgacaagtattttcagtggaattagggtcatgatgtcatgcttatttcaaaagatagcttcatctgtgccttcacccagacttagggttctagattcttmtagattctacagcaggcactggcaagcttttgcttaagaaggcaagccgggaatggtggctcacgcctgtaatcccagcactttgggaggccgaggcagg

SEQ ID NO: 32342 - DNA, 201 bp, Homo sapiens
atgcgtgctcttttagggacatctcttcaaataagaacaggttgtaacctacactcaaaagagatgctcttggcaaggtatggcccctaaggtttgaaagsgttttccaggcctgctgtcaggccaggctggactgtccacaatttcttgtcctgcctcccgtgatgctagccatggatgcaccccagaagcatttagaat

SEQ ID NO: 32343 - DNA, 201 bp, Homo sapiens
gggtcatgggcttgctatatttttcattcaaccgccaagaaatcttgagaggcagctttatcatctccatgtgaggaggaggagattcaggcccagcgtartggcttgcgaaaagattccagcactaaagtttgaccccagtcctacctgacttcctttctccagctgtgagactcccctgtacaatttttctggagggtc

SEQ ID NO: 32344 - DNA, 201 bp, Homo sapiens
gccttggaacttgcttgcatccctcccccacgcgaggcgaggccctgaggagcgggattcgctgacccatgctggcagaacgggtgatggatgaggcagasaagggtacaggctggctggaccatgcgatggggaatgcaggtggaacaggcttcctcctgaatcaggagtggaagaggagtctggggtgaagccaagggg

SEQ ID NO: 32345 - DNA, 201 bp, Homo sapiens
aggcaacagaaaggtctctgttacgaagggggaactagttttcattgtcactgtattaagcagaagttgggaatcatagaagaccttgatgttaccatatyccttgttaaatttcctctaatactattgagaagtttatcctctactttttcctgtagagtaaaagatatcgattttgtttctgtcggcactgccttggaa

SEQ ID NO: 32346 - DNA, 201 bp, Homo sapiens
agtctttaaaaggcaacagaaaggtctctgttacgaagggggaactagttttcattgtcactgtattaagcagaagttgggaatcatagaagaccttgatsttaccatatcccttgttaaatttcctctaatactattgagaagtttatcctctactttttcctgtagagtaaaagatatcgattttgtttctgtcggcac

SEQ ID NO: 32347 - DNA, 201 bp, Homo sapiens
aattctatttatttagtataaacccactggagtgtgtacctaagcatttcattttctttggagcgattgtaaatggcattgtgtttttaattccaacttcyacatatatctagaaatatgattgagttttgtgtgttgatcttgatcctatgagcttgctgattgcatttattataaagttccaggagttttttatttttg

SEQ ID NO: 32348 - DNA, 201 bp, Homo sapiens
tattttagcttcctaagacctgtgctttttcatataaattgtacaatatggttgtctatgtctaccagaagccttgctgcagttttaatggggtttaaatstataggtctaacattaaacctatagatcaattcgggagaattgacatctttactatgttgagtcttccagtttgtggacatggtatgtaattctatttat

SEQ ID NO: 32349 - DNA, 201 bp, Homo sapiens
tgggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtct

SEQ ID NO: 32350 - DNA, 201 bp, Homo sapiens
gcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgtc

SEQ ID NO: 32351 - DNA, 201 bp, Homo sapiens
tgtagcttcctttatacacaactacatcaagacagtgaacagtgcatcaccacaaaattcccttgcgttgccttgcaaaccacacccaccttccttctgcscctgcctcatccctgacccctggcaaccactaaactgttctccacttttaaaatgttgttttttcaaaattattatataagcagaatagcatagtatgta

SEQ ID NO: 32352 - DNA, 201 bp, Homo sapiens
tgtgtctacatatgtagttttatacagtgtcatcaaatgtgtagcttcctttatacacaactacatcaagacagtgaacagtgcatcaccacaaaattccsttgcgttgccttgcaaaccacacccaccttccttctgcgcctgcctcatccctgacccctggcaaccactaaactgttctccacttttaaaatgttgttt

SEQ ID NO: 32353 - DNA, 201 bp, Homo sapiens
gaatctatggatcttattcagatttctcattttacctgtactcaagtgtgtatatgtgtgtctgtgtctacatatgtagttttatacagtgtcatcaaatrtgtagcttcctttatacacaactacatcaagacagtgaacagtgcatcaccacaaaattcccttgcgttgccttgcaaaccacacccaccttccttctgc

SEQ ID NO: 32354 - DNA, 201 bp, Homo sapiens
ttttaattgaagactcacatgtagttgtaagaaataatatacaatgattcctcatattcttagctcagtttcccccagtgatagcttttgcaaaacaattstgcaatatcacagtgttgacacttacagaatctatggatcttattcagatttctcattttacctgtactcaagtgtgtatatgtgtgtctgtgtctacat

SEQ ID NO: 32355 - DNA, 201 bp, Homo sapiens
tcctcccatctcaacctcccaaagtgttgagattacagttatgagccaccgcatccagcccacaagtattattccaaactgtaaaatcgtgaaatgttttscattagaatcagaaactagacaagaatattcatgatagctgtcaattgtcacattattttagaagttttaacaaatacagtaagacaaaaaaagtcttaa

SEQ ID NO: 32356 - DNA, 201 bp, Homo sapiens
gcccaggctggtctcgatctcctaggctcaagcagtcctcccatctcaacctcccaaagtgttgagattacagttatgagccaccgcatccagcccacaartattattccaaactgtaaaatcgtgaaatgttttgcattagaatcagaaactagacaagaatattcatgatagctgtcaattgtcacattattttagaag

SEQ ID NO: 32357 - DNA, 201 bp, Homo sapiens
tggtctcactatgttgcccaggctggtctcgatctcctaggctcaagcagtcctcccatctcaacctcccaaagtgttgagattacagttatgagccaccrcatccagcccacaagtattattccaaactgtaaaatcgtgaaatgttttgcattagaatcagaaactagacaagaatattcatgatagctgtcaattgtc

SEQ ID NO: 32358 - DNA, 201 bp, Homo sapiens
gaactggctgcaccagcaggagccaatgattacccatctcccatgtttagtgacatcatgttgatagcttgatttcagccatagtgagaatattttcaccmcggaaattggcacatgctacacatcagggctccctcctccccaccaaagctgatcattaaacattttctagaacatacctggaaggcatctgggaagagg

SEQ ID NO: 32359 - DNA, 201 bp, Homo sapiens
agccaacaaaattcaataggcacatgccatgtacatgcctgtgttatgccgggaacttcttaacatttccagaatatgtgtaatcatatttgttacatgcwatatgaaattatgtgtaaactgtccaacctgcaggaggcagtagatcaatcaattacatgtgattaatcctccccctatcttacagagaataggagagaa

SEQ ID NO: 32360 - DNA, 201 bp, Homo sapiens
tgtcacttcttctttttttttttttttaagacggagtcttgctcttttgccaggctggagtgcagtggtgcaatctcggctcactgcaacatttgactccytggttcaagcgattctcctgcctccgcctcccaagtagctgggattacaggcatgcaccatcacacccagctaatttttgtatttttagtagagacggga

SEQ ID NO: 32361 - DNA, 201 bp, Homo sapiens
tataaatgcagacacatacagacacccacacccacacatacagacacacacagaaacatatacacatttaggtcgcgatttcttcacaaggacattcttayagacatgtcatgaagggacttggggctcagagaaatgaagtaactcagctaagtctgtacagtacttagccaggggatttagaaatccacccagggatgg

SEQ ID NO: 32362 - DNA, 201 bp, Homo sapiens
gtatcagtaattttaaaagccagcaagtgttctaccagctgaagaagttttcctaatggtggctggtcaaacgtattacttaactaggcgtatagaattgrggggaaatgcaggatgtaatgaaatgacattggtcaatcctcagtaaatgtttttttcaaaggcttggcacaaaaaatgtgcaaaatcttggaggtagat

SEQ ID NO: 32363 - DNA, 201 bp, Homo sapiens
atgagatttgggtggggacacagagtcaaaccgtatcactctcccacccaacacttgcagaaacacacacacacacacacacacacacacacacacacacmccccttcctacgtcctacatccctgtacttggaaagcaatcatatttaaatcattgctgctggaactttagttgactttataagttacattttacataaa

SEQ ID NO: 32364 - DNA, 201 bp, Homo sapiens
ttttcattaattaatgggtgtatttattggaataaccgtgtaaggttgccatttttatttccatctgtgtgttacagatgagatgtgtaatagaaagggartttgcccaagctcacagtcacaggctggtggagttgggatttcaaacccagagtgtctgattcctgaacctgtgctcttgtctcttccttcagtaccaca

SEQ ID NO: 32365 - DNA, 201 bp, Homo sapiens
cctggagtgaagtgtaagcgtcgctgttcactggctgagtcatctttggtaggtccctttaccactttgccactttaagtctccgtttcctcatctgtaamatagaggtaataaaaacagctaatatttacagagagcttactccttgttagcagttttcattaattaatgggtgtatttattggaataaccgtgtaaggt

SEQ ID NO: 32366 - DNA, 201 bp, Homo sapiens
tgggcatttatttccaaagaatgatttcactcaactgaggaattctaatgttttaacagcatcctacttatttctaaagtgttggggtgaatttgccaagktttgaaaagtgcatttgtaagccagtaggattcaatctgaagtcagggataacagagccgggggcggaggctaggtctccttacatattttgttcacaat

SEQ ID NO: 32367 - DNA, 201 bp, Homo sapiens
tgatggggaaagaggatgtgagctgaggcttggaaccaagcagagcttgggctttggggtgctgggaggacagaatgctggaaacagaggtaagaagggtragcacctagtcaacatgagtgatttagctttgggagctgatcaagtgatatgatttggctctgtgtcccaactcaaatgtcatctcgaattgtaatcccc

SEQ ID NO: 32368 - DNA, 201 bp, Homo sapiens
gccctggagtttcacagaagaaggggctttcttccagcttggggatggaggtgagctgtcattctggatgatgtgatggggaaagaggatgtgagctgagscttggaaccaagcagagcttgggctttggggtgctgggaggacagaatgctggaaacagaggtaagaagggtaagcacctagtcaacatgagtgatttag

SEQ ID NO: 32369 - DNA, 201 bp, Homo sapiens
ccaatggtgacggggtttgttttattcatggactttttgaaaaaaaaatcactggtttattggaaaccatagagaagtataagtaattattatgctttttwaaatacaaccgaggttcctcatcatgatacgttaagggaaaggaagacagggcaggagggtggtgtggcacaaaggcggctctgtctgacctgtcacgtt

SEQ ID NO: 32370 - DNA, 201 bp, Homo sapiens
tcaggcccataaaatactgcacatcttggcatcttacctataaaaataatgcagatacattcgtaactccccaggttttcgggagtggaaatgagggcagytggggagtgaatctgtcgtttgttgaggctctttttcctgcttgccagacactgatctaggctcattcatacaccagttcattcatcctcataacagttc

SEQ ID NO: 32371 - DNA, 201 bp, Homo sapiens
agtgttgtgataaacatctctgtgcataaagcagtttctatagttcccattatgtctttaggatagattcccagaaatggaattactaggtcaaaggttgsgcacattttttaaaggtttgtgagacatattgccaaattgctctccaaaaggtttgtagcaatttaaatgatcagaagcagcactgaagtccagtttcgt

SEQ ID NO: 32372 - DNA, 201 bp, Homo sapiens
tttatccatttctatgttgttggtcatttatatggttttaaatacttttggtgtcataaggagtgttgtgataaacatctctgtgcataaagcagtttctrtagttcccattatgtctttaggatagattcccagaaatggaattactaggtcaaaggttgggcacattttttaaaggtttgtgagacatattgccaaatt

SEQ ID NO: 32373 - DNA, 201 bp, Homo sapiens
tatcttaaaaatatttaaaaagaaggaagaaaatcactcataattctgctgcccatggcaaccacaattaacccatgcctgccttccagtctttttaccaygtgttgtgttgtgtggtgtttgtcccacatagagatcattgccatacgcccatttggcacattgcttatttttccctgtctttatacatttcatcatgtt

SEQ ID NO: 32374 - DNA, 201 bp, Homo sapiens
acagatcaccaaaactgatataataataatttaaaagcttgaaatattgtaagaattatcaaaatgtgatacagagacatgaagtgagcaggtaccattgsaaaaatggtgccgatagtcttccttaatgcaaagttgccagaaaccttcgatttgtaaaaaacacagtatttgcaaagtgcaataaaaggaaatgcaata

SEQ ID NO: 32375 - DNA, 201 bp, Homo sapiens
tttagcataattcttaaggaccctaggattttgggaatggtaaatgagcttggcttcaacttgaagtcaccagcagggaagagagtcagcctgtgcttcgmagctttgaagccaggcattgccttctcctccctagctctcaaagtcctagacagcatcttcttccaacagaaagctgttttgtctacattgaaaatctgt

SEQ ID NO: 32376 - DNA, 201 bp, Homo sapiens
cgacagtgggcataaattattcagtaaatcatgccataaatagacgtggtctcatccagggtttgttattccatttatagagcacagggagagtaggtttrgcataattcttaaggaccctaggattttgggaatggtaaatgagcttggcttcaacttgaagtcaccagcagggaagagagtcagcctgtgcttcgcagc

SEQ ID NO: 32377 - DNA, 201 bp, Homo sapiens
cctcccacagtgccacaattacaggtgtgagccaccacactggaccaagcagaatatttttaaaggaatacaaattttttcccaacagtaggtctcgacastgggcataaattattcagtaaatcatgccataaatagacgtggtctcatccagggtttgttattccatttatagagcacagggagagtaggtttagcata

SEQ ID NO: 32378 - DNA, 201 bp, Homo sapiens
ccaaatcagcctcccacagtgccacaattacaggtgtgagccaccacactggaccaagcagaatatttttaaaggaatacaaattttttcccaacagtagrtctcgacagtgggcataaattattcagtaaatcatgccataaatagacgtggtctcatccagggtttgttattccatttatagagcacagggagagtagg

SEQ ID NO: 32379 - DNA, 201 bp, Homo sapiens
gatacctcagagatattgcagatcccgttccagaccaccacaataaagcaaatatctcaataaggcaagtcacatgaattttggagtttcccagtgcatayaaaagttgcttacacgatataatagactcttaagtgtacaatagcattgtaagaaaacaatgtacataccttaattttaaaatatttcattactaaaaaa

SEQ ID NO: 32380 - DNA, 201 bp, Homo sapiens
gagtatatgcatggagaatattttctgagctggtgatgagctgcagggggcctctcccagcccccgcactggttgcacttttaaataagagaaaaaaacartgataggactgacctgcgtgtagaagtttcaagttacaagaaaaacacttcacaggatccaaatccttaaagtcctgaaggaaacagagagcatatacac

SEQ ID NO: 32381 - DNA, 201 bp, Homo sapiens
ttttcactgatgcagatatttctgatcttttcatctcggttttatttctcactctcccactgcataaaagattaagaaagcactcgcatgaatgtttgcasatcatttaaatattcattttcattaatttattcatagtcgtaaagtttattgcctagaatatagagtcgtagaattttagagctggaagacaggagagaa

SEQ ID NO: 32382 - DNA, 201 bp, Homo sapiens
tattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcaca

SEQ ID NO: 32383 - DNA, 201 bp, Homo sapiens
cgttcaaggcattcagtttctgagtcctcaaggatggtaaggagagctgcaaatgggctcccttctcaagcaaaggcatcttatgccatcatgcacgtttytacacatctgcctgtagatacactctgtaggacaaaccaggtggctctgtccttcaggcaaagagctccttaattgaaaatgatgtgtgaaatttcaaga

SEQ ID NO: 32384 - DNA, 201 bp, Homo sapiens
tagtgggaaatgtttaggggctcaagcacaaccacaaggattcactccttccttggattttgtgcctcttcccctgttcctgaggcccccactgggaaccyttagctggagaacacccgtttcattatggaacatggagaaaagggtgattgtcagctccaatttattccatactatctgattcaatctgtagtttgactt

SEQ ID NO: 32385 - DNA, 201 bp, Homo sapiens
ttcatgcatgaaacactcagggaggtaggagatccatgagatccaagctaaacaattctggaagagttacctgaagttgacacttaattcaagctgcatcrtcttcctcctcccagcagatgaagaccaaaggtggagggtggtgggggtggggggcagggagtaggggggagggggggagggggtgtggggagggtgggg

SEQ ID NO: 32386 - DNA, 201 bp, Homo sapiens
gaatgttttgaaatgagcttgattctgtttacccatccttcttaatccaacaactctgctggtctctctgctgacacaagatcgttcgcaggttatagaasgatttaacacgtcaggtaaggtggaatttggtaaattccccaaatttacaaatagatgaaagttgggtaaattccccaaaattacttgatgacaaagatc

SEQ ID NO: 32387 - DNA, 201 bp, Homo sapiens
atttctctttacaaaaagaaaaacaatgtaaggtcccgtgacaattagccttactgccggggagaccataaggagtggtggagactgtggtaaactgcagsgcgcacactctgttaacagaggaggtcactttccattctagctgactgttgtcatatgaggatacacaactatgctggccagtttctttaattttttttc

SEQ ID NO: 32388 - DNA, 201 bp, Homo sapiens
ttaaacaaccagctcccgtgggaaatcacagagggagaactcactcactaccatgaggatggcatgaagcccttcatgagggatccgtccccatgacccaracacctcccggtaggctccatctcctgacatcttcacacaagagatcaaatgtcaacatgagatttggtggggacaggcaaaccagatccaaaccatagt

SEQ ID NO: 32389 - DNA, 201 bp, Homo sapiens
gttccttgttttgtgtaattggtctttagcctgatctgattcatctggcgaaacccctttttccagtaaaagtcgttggcgaggagtgaattgtgatggaracagagacagatgtatgtacctttcatggacataatttccccaagactgaacacaaaaatgagggtttttggagatctctctggaattaatgtaaacgtt

SEQ ID NO: 32390 - DNA, 201 bp, Homo sapiens
gaaatggttctctgagtttcagctgcagttcagggaaaaggccagcagccacgttccttgttttgtgtaattggtctttagcctgatctgattcatctggsgaaacccctttttccagtaaaagtcgttggcgaggagtgaattgtgatggaaacagagacagatgtatgtacctttcatggacataatttccccaagact

SEQ ID NO: 32391 - DNA, 201 bp, Homo sapiens
caggcaaggcttggaataacttgtctaagaatcctcatcttaaccctgtgctagaacaacaagcttggaaggagccagccaacaggagaaagccagagcawgactctgtgctggacaagaagtcctgagcactggggagttgacttcatattggaggcagagaagaattacctgccgatggctgttggcccatggcaacac

SEQ ID NO: 32392 - DNA, 201 bp, Homo sapiens
tgagtcgccacactcaattatacacttaaatatacatatatatatacaatatacatatgtaaatatatctgcatatacatgtttagggacaaaaacacggragtaccatttctgtctttgtctctctctctctttctctcacttgactctgttgggagctatattagttgttttctctttccaaaccaccttctggaggtc

SEQ ID NO: 32393 - DNA, 201 bp, Homo sapiens
cttcttgatttacatggtggtggagagtggctgagaaaccagggagaaacaggaaggagctgattgaggagaccaaaggagggtggggccgcagctctcargcactcttggtgttcagaaggccagcttgaagaaagatgtgcatatttgcaaatgcatttcttgttcctagtgaagaggtgaggaaggacactgactgtg

SEQ ID NO: 32394 - DNA, 201 bp, Homo sapiens
attcactaagtctttcaccatccttcactcatcttacctccttcttctgtggcatttcataaatttaatgattgtaattgtgattacaacataattgtttrtgtctaccccaggctttgcaacagggaactatatcattattttgcagacacaacaaattctgcaagcatgtatctttggaataaaggagagagggttgga

SEQ ID NO: 32395 - DNA, 201 bp, Homo sapiens
ggttagtgtgtggttaagcaccttcccacaagctcaggggaaaaaaaggtcccctccccagattttttttagaactggaagtttccatttcctggcactgstgaaagctctaggacataaaacttgggagccgatggccttcaggctgcccataatgtgaagagaggtcatttcagacattcagataaagtctgtggctcc

SEQ ID NO: 32396 - DNA, 201 bp, Homo sapiens
gaccccttcttctccaggaaactctgttcctacctgctcctcttgtggctaccttgggaggtgccatttttatcaaggttagtgtgtggttaagcaccttsccacaagctcaggggaaaaaaaggtcccctccccagattttttttagaactggaagtttccatttcctggcactggtgaaagctctaggacataaaactt

SEQ ID NO: 32397 - DNA, 201 bp, Homo sapiens
tcttcttactcaactctcccgagaggcattgtggacgcctgtggggttggtttttggcacccatccctgaccccttcttctccaggaaactctgttcctayctgctcctcttgtggctaccttgggaggtgccatttttatcaaggttagtgtgtggttaagcaccttcccacaagctcaggggaaaaaaaggtcccctcc

SEQ ID NO: 32398 - DNA, 201 bp, Homo sapiens
gcatcgttcttcttactcaactctcccgagaggcattgtggacgcctgtggggttggtttttggcacccatccctgaccccttcttctccaggaaactctsttcctacctgctcctcttgtggctaccttgggaggtgccatttttatcaaggttagtgtgtggttaagcaccttcccacaagctcaggggaaaaaaaggt

SEQ ID NO: 32399 - DNA, 201 bp, Homo sapiens
cctgtgcaaggatcgttcactagtgttctgcatcgttcttcttactcaactctcccgagaggcattgtggacgcctgtggggttggtttttggcacccatycctgaccccttcttctccaggaaactctgttcctacctgctcctcttgtggctaccttgggaggtgccatttttatcaaggttagtgtgtggttaagcac

SEQ ID NO: 32400 - DNA, 201 bp, Homo sapiens
taatagagatctttgaaagaaaattcaaagattgaagtttgtattctcctaaactcctgcaaagaagtcctgtgcaaggatcgttcactagtgttctgcaycgttcttcttactcaactctcccgagaggcattgtggacgcctgtggggttggtttttggcacccatccctgaccccttcttctccaggaaactctgttc

SEQ ID NO: 32401 - DNA, 201 bp, Homo sapiens
ccgaattctgaatttcagcgtggaacagggcatggaaagcaaacacaatggggaaaattgccgtggccggtcccgacaatgtgtggattaaaaaaccacaygcatgcacagagacctgatgtgaatggtatttctgagtggaagctaagtaggagctgaaaatggccttttaaaatacagaacataaggatgcaattcaca

SEQ ID NO: 32402 - DNA, 201 bp, Homo sapiens
gctctaacgttggatcatgtgtggagtccccagttttcaacattaaaaataaagtatttgttgaagtggggtttttttcttcttacagtatatgtagaacyattttcttgaaaatgtttcttagaaatttgttacttagaagatttgagccaatgatacattgccgagatttgtaagagtaagaccagcctacgctgagta

SEQ ID NO: 32403 - DNA, 201 bp, Homo sapiens
tgacttcctaaaaccaccgttctcactcaaagccgaatctcatcctgactgaaatgtcactagtccttttttttttttttttttttttttttttttttggkcatattttctccatttggagaggctggctgacccatcaatgggcagtgtgggggaatggagagacctgggattttggggacaacagtgaccatgagggga

SEQ ID NO: 32404 - DNA, 201 bp, Homo sapiens
aatgtcaggaacctgggtttctaatgatggttggctgtcacccccatttcccacactttaaatgagagaagtaaacatctgacttcctaaaaccaccgttstcactcaaagccgaatctcatcctgactgaaatgtcactagtccttttttttttttttttttttttttttttttttggtcatattttctccatttggaga

SEQ ID NO: 32405 - DNA, 201 bp, Homo sapiens
atttatcattttaggtggagatttgagtttatgtctcctacagacagccgtagactttgtttcattttaagatcagtgttgcagacgctgctgagtgtctycaaatgtctgttctccctttattacctactaataaaatacctaattttcaacagcctgggaagagactatatttccctgcttgcctttgcagctagagtg

SEQ ID NO: 32406 - DNA, 201 bp, Homo sapiens
atagagttatatggatttatcattttaggtggagatttgagtttatgtctcctacagacagccgtagactttgtttcattttaagatcagtgttgcagacrctgctgagtgtctccaaatgtctgttctccctttattacctactaataaaatacctaattttcaacagcctgggaagagactatatttccctgcttgcct

SEQ ID NO: 32407 - DNA, 201 bp, Homo sapiens
gggtgtgttgactatattctccacagaaactttttgaagtagcatcctcactcagcacagaacattttgacaatacacttccagggcaggtggtttcttamtatgtccctccctacccccacatactttgggactcagaatgtagggagtgtactctcgagggatgcggcccatacgtgaatgcatggaggcagcatataa

SEQ ID NO: 32408 - DNA, 201 bp, Homo sapiens
actcatctgcagctgtattcgctgtgcctatggtagtgcctggcaaatgcacagaagtgggtattactgaggactttgtggttcgaatggaatgagtgtgytgctgacagtgttgcgagtcatctgcaaatgaaaagtccttccttctcttcccttctggaaccttccaaagaggctagcctcctgagagggcgtctcctg

SEQ ID NO: 32409 - DNA, 201 bp, Homo sapiens
accttccctgaccactgccacatggaatagtactaatacttcatgctcatcctctgcctgccctgggtttttaatttgtgcgtgtgggtggggtggggggygggggggggcacttatcaccacctgcatattatgcttttgtgcatttcaggttggtctttcccgcaagaaggtaaactcatctgcagctgtattcgctgt

SEQ ID NO: 32410 - DNA, 201 bp, Homo sapiens
tgagatgctcttctcggctcctgtgagggctacccctttaccctttatagtgtctgcccggacatctcctcactagagaccttccctgaccactgccacawggaatagtactaatacttcatgctcatcctctgcctgccctgggtttttaatttgtgcgtgtgggtggggtggggggcgggggggggcacttatcaccac

SEQ ID NO: 32411 - DNA, 201 bp, Homo sapiens
aaaaccagtcttaggttctacaatagtgatgttatctacaggaataattggggaagttccaaatcttgtgacctcctatgcctacatcttagctgaattcmgacccctctcctaatcctaaccttgtggccttttaggagctttacaaaggtggtttcatttcgggaaaggctgttatcattcttgctttaagattaaagt

SEQ ID NO: 32412 - DNA, 201 bp, Homo sapiens
ttggatggagaaaaggtaatggggacctcataatagtcgtggagggacaactgggatttatttccatagggaaggcagagactgtttgccagggaaccaasgcctttcaaagttgaggacacttcccggtgccgtgcggtgtaaatcacagtgcaaactatgcgattatcccctgcagaggaatcgagtgtgactttatgg

SEQ ID NO: 32413 - DNA, 201 bp, Homo sapiens
cattttatagcccatctccctctccagtgaggcttttggccactggccgttaattggtaaggttcttgaaaactgaagtgatggtatcagcatggatgccygtgctttctgatgccactgaagatggatagaagcttcaagttatgctttgtgcagactgaatttttccaatttgtgcttagtagcatcttattatattag

SEQ ID NO: 32414 - DNA, 201 bp, Homo sapiens
tgaatagattccattttattttatttacattttgtacaaagctgataaataactgaaaccaaattagctcaaactggttatatttctgggtacaaaccagrtgtatagttaatccattgttgtttctgtgtcgaccaccattgtcctcacctatacttgggcagtgggggtggggaggagaacataaaaacccaccaagcc

SEQ ID NO: 32415 - DNA, 201 bp, Homo sapiens
agtttgtccttggcaattccttattgaatagattccattttattttatttacattttgtacaaagctgataaataactgaaaccaaattagctcaaactgrttatatttctgggtacaaaccaggtgtatagttaatccattgttgtttctgtgtcgaccaccattgtcctcacctatacttgggcagtgggggtggggag

SEQ ID NO: 32416 - DNA, 201 bp, Homo sapiens
tgttgccctggctggagtgcaatggcgcgatctcggctcactgcagcctccgccttccgggttcaagtgatgctcctgcctcagcctgcctcccaagtagstgggattataggcgcatgccaccatgcccggctaattttttgtatttttagtagagatggggtttcactatgttggccaggcatctcaatcgttttacta

SEQ ID NO: 32417 - DNA, 201 bp, Homo sapiens
ttttgagatggagtcttgccctgttgccctggctggagtgcaatggcgcgatctcggctcactgcagcctccgccttccgggttcaagtgatgctcctgcstcagcctgcctcccaagtagctgggattataggcgcatgccaccatgcccggctaattttttgtatttttagtagagatggggtttcactatgttggcca

SEQ ID NO: 32418 - DNA, 201 bp, Homo sapiens
agtgagcacattaactatatcgtcaactacctgttctcaaacactttaacaatcagctcaccaatatgggtgtgatcttgacattgagatgtagagcttgrcacctgcatataaagtagaaactcaacagtgtttgagaatttgccattgcatctcagtcttttttatttatatgttttttctttttttgagatggagtct

SEQ ID NO: 32419 - DNA, 201 bp, Homo sapiens
gcgaatctcactgcataaaggtgattttgaaaacatcacttttcctccacactaatgtgtgagcttagccagagtaggagatatatcttacttaaaaaaamaaaaaacaaacaaacaaaaaaaaaaaactccttcttcatttgttatagttccaggatagagtgtgtacctgtatagagagagtcaggcagatacaggtgt

SEQ ID NO: 32420 - DNA, 201 bp, Homo sapiens
caaggtagaagacataggtggtcaagaatttagaaagacccggactcgaatcccagctctgatccatctcagctctgccatattgccaagttccgctgagrctccatttactcacctgttgtatcatctgaattatttccatatccataatgtgcaaggatatccttccatgttattagaaatacagatacaccatcatta

SEQ ID NO: 32421 - DNA, 201 bp, Homo sapiens
atttgtctcaaggtcctgataaatgggaactggaggaactggcctactatggtattacaggctagcacatggtttgcattctgagggagctcagaataggyaaggtagaagacataggtggtcaagaatttagaaagacccggactcgaatcccagctctgatccatctcagctctgccatattgccaagttccgctgaga

SEQ ID NO: 32422 - DNA, 201 bp, Homo sapiens
gggcacttcaaacctacaaaacatagtgctaaaattaaggagtgtatagtcgtgtgtttatagggacaggatatttattatctatcacttttgaaaatgtyattggcattatcgttcacttttacaaatacgaaggaaaaatatgaaggagttctagaaaacaccagaagtgattttgccgccatgggcctgaattgaaga

SEQ ID NO: 32423 - DNA, 201 bp, Homo sapiens
gggcagagggttgcctgggacaaaggcattataagcttattcatttaacttgagtacagggtttctcaagctttggcactgccaacatgtggggttggatrattttttgttgggatctgccctgtgcattgtaggatgtttagcagcatccctggcctctacccactagatgccagtagcatcccttccccctcttgtcac

SEQ ID NO: 32424 - DNA, 201 bp, Homo sapiens
tgcgcgtgttgcaatttcagatttaatcaggggaatacattaatttctggaactaattacagattttaaaagagtgatgggtctggtacagtggctcacayctgtaatctccacacttggggcggtcaaggtgggaagatcccttgagtccaggagttcaggaccatcctgggcaacatagtgagaccttgtctctatgaa

SEQ ID NO: 32425 - DNA, 201 bp, Homo sapiens
ggagcaagcatttctaacaatcatattgcttaagaagtggatggcaagaagataattactaatatgtctgcaattgatctgaaattgacacagttgatctmactgattcatggggaccctgggagtatgtttgtgtatttgggggttgggatgggggggtgggtggagggtcagagaggtggcaaaagcaggtgggaacag

SEQ ID NO: 32426 - DNA, 201 bp, Homo sapiens
cgagtgctatttctttatggcactgaggagcaagcatttctaacaatcatattgcttaagaagtggatggcaagaagataattactaatatgtctgcaatygatctgaaattgacacagttgatctcactgattcatggggaccctgggagtatgtttgtgtatttgggggttgggatgggggggtgggtggagggtcaga

SEQ ID NO: 32427 - DNA, 201 bp, Homo sapiens
actataaatctttctgctataaagacacatgcacacatatgtttattgcggcattattcacaatagcaaagacttggaaccaacccaaatgtccaacagtrgtagactggattaagaaaatgtggcctttgcctcttttaaaaagttctaagttgctagccagtcggaacaaatacagaatgtgaggtccctttccagcca

SEQ ID NO: 32428 - DNA, 201 bp, Homo sapiens
gaactcatccttttttatggctgcatagtattccatggtgtatatgtgccagccatcccgttactgggtgtatacccaaaggactataaatctttctgctrtaaagacacatgcacacatatgtttattgcggcattattcacaatagcaaagacttggaaccaacccaaatgtccaacagtggtagactggattaagaaa

SEQ ID NO: 32429 - DNA, 201 bp, Homo sapiens
gcctcaaatttctttagggttatcctttcattccagcaattgaatttgatttgcactgtttcacttctctacaagggtgtaaaaagtagaggttcctcttsaaagaatttcctccccatctaattaggaataaatagtaacttctcttagaagcaaagttaattcaaagacctgtgctaacattcttaaatatctgctagc

SEQ ID NO: 32430 - DNA, 201 bp, Homo sapiens
gaatggggctacataggttgggggaaggaggtaagagaggaagtgaggagaatagggtgggtcgaacctgttgaaggcccagagcttgcttctcttctgcygcctttaggaaacgagatgaattgttaaacttcttgcactgagctttaccaggtgagctgacagttatcctctgcattcatcaatataagccccataaaa

SEQ ID NO: 32431 - DNA, 201 bp, Homo sapiens
ctctaccaccatccccagagtgacctccagaactgtaagggacccccgcctttggtacagagatgggagttaaacacaggtgtccactggagtcatgattsctctattccctggacaaatatgcaatgagaatccctgagggacaggcactgtgctagatacccgagatacaaaagcgacaaggtttctatcctctgacag

SEQ ID NO: 32432 - DNA, 201 bp, Homo sapiens
gcctcgttaccacctttctgagaaattcaagtgccacacagtggtcaccagcattgtagctgccctgatgttccgggctcagctgcaatatagcacatctstaccaccatccccagagtgacctccagaactgtaagggacccccgcctttggtacagagatgggagttaaacacaggtgtccactggagtcatgattcct

SEQ ID NO: 32433 - DNA, 201 bp, Homo sapiens
tagttgtagcaaaagtccagggctgccgctcattcactctgctcggacctttctggtcacttgtcttctgtggtttggtccttgtggccagggacaatgawactctcattgattaggcctgagttatgtgctctctcctagagccaggaagaggcttcggccctgcccagacccggtggcctgagagtcacagtgaggcgc

SEQ ID NO: 32434 - DNA, 201 bp, Homo sapiens
atcattgggataactagaaccacagagatccccctagacttgtcagccagggaacctgacactcttagaccttcttctgagtgctttgtccttgtccggasagctcggggaggagcaaggttgtactgggatttttttccgatcacagaaagtaacttagctagctgttgcccagccaatttgcccaagggagaggttgct

SEQ ID NO: 32435 - DNA, 201 bp, Homo sapiens
aagaaaaattctgtgagtctaattatggaaaaaattactaagatatgttttaacatgccctagacatgcacagaaaaaaaagactggaaggaaatttattragatgttattgtttatgagtgttctaattatgatttttaacaatatattatcagagttttctgacaaagaattaactttttattttttttgagacagagt

SEQ ID NO: 32436 - DNA, 201 bp, Homo sapiens
acatttcaactttcttgaactcctgaaccagccttagattgcctagtaccagggttcttctttttttaaaaaatttatattttattttaagttcaggggtmcatgtgcaggtttgttatataggtaaactggcgtgatgggggtttgttgtacagatgatttcatcacccaggtattaagcctagtgcccattagttattt

SEQ ID NO: 32437 - DNA, 201 bp, Homo sapiens
tattataatgtatgtaatatataatatattctatgtaatatataatatattctatgtaatatatattaatatgtagggaatatgttacatattatgttgaragtgtatatattatatatgggtttctatatattataataaacccatatataatatacataatagactatacacatatacagctaatatatatacacaata

SEQ ID NO: 32438 - DNA, 201 bp, Homo sapiens
gtctatatattatattataatgtatgtaatatataatatattctatgtaatatataatatattctatgtaatatatattaatatgtagggaatatgttacrtattatgttgagagtgtatatattatatatgggtttctatatattataataaacccatatataatatacataatagactatacacatatacagctaatat

SEQ ID NO: 32439 - DNA, 201 bp, Homo sapiens
tatattacatatacataatatatacataatatataatagactctataatatagactctaatatgtagtctatatattatattataatgtatgtaatatatratatattctatgtaatatataatatattctatgtaatatatattaatatgtagggaatatgttacatattatgttgagagtgtatatattatatatgggt

SEQ ID NO: 32440 - DNA, 201 bp, Homo sapiens
atatatgtatatacacatatgtatatatgtatgtatagagagtctattatatatattacatatacataatatatacataatatataatagactctataatrtagactctaatatgtagtctatatattatattataatgtatgtaatatataatatattctatgtaatatataatatattctatgtaatatatattaatat

SEQ ID NO: 32441 - DNA, 201 bp, Homo sapiens
tatatgatatatatatcttattatatattatatatatagatagatatctatatacagatatctgtatacagatatctatatatatagatatctatatatayagatatctgtatacagatatctgtatatatatatagaaagagagggaactgaacgggatgctttttattttgggctgttattaggtagactctcctggga

SEQ ID NO: 32442 - DNA, 201 bp, Homo sapiens
aaacactagggttgctttaaaatgtcaaggccaactcttatgatatgcggaagccttcgcccccttcttgagggtgtttagggattagatgagtgtcccakctgggtttcccatccctgcagagcccacgtgtggggtgctgagaggtacgtggtgggtgactccctggggagcactgtttggtactgatcactgtcccat

SEQ ID NO: 32443 - DNA, 201 bp, Homo sapiens
ccctgtctctacaaaaagtaaaaaataaaataaattggctgggtatggtggcacatgcctgtagtcccacccactcgagaggctgtgatgggagaatcacscgaggctggggaggttgaggccgcagtgagccgagatcgagtcactgcactccagcctggacaacagagtgagaccctgtctcaaaaaaaaaaaaaaaaa

SEQ ID NO: 32444 - DNA, 201 bp, Homo sapiens
attactcatctgaagttatactattttaggatcttggggcagtgaggactttggaaatggaacaggatgctcctttaagttagggtaaaatgaagtctatraaaactgtttttctatatcctcctcctaccccacaaagaaagttagggtaatatattcttatataaaattgacatttttaactttaatgagaaattgctt

SEQ ID NO: 32445 - DNA, 201 bp, Homo sapiens
tgaatactgagtaaataaagaaaagttaacacagtggagtccaggtacagtggctcatgcctgtaatcccagcactttgggaggtcaaggcaggaggatcmcgtgagcccagcagttcaagaccagccttggcaacatggtgagaccccatctctacaaaaaataaaataattagctgggcatggtggtacatgcctgtag

SEQ ID NO: 32446 - DNA, 201 bp, Homo sapiens
acacttcccttctctgtgctttagtcaccctaccctcggtcaactcctaactcctgcctgccacagggcctttgcacatcctctgccggggaggctctccyttcaccttcattaggttatcagatctcagctcacacatcacatcttctgagataccttccagactcccctggccacggtcacttcctttgctgtggactc

SEQ ID NO: 32447 - DNA, 201 bp, Homo sapiens
ccttttcaaaacactaagtgcatcatgttaaccttccactcgcttctttaagtttcctcactccttttaggtgaacaacccaaaccctcatatgccctagrggcccttttcagccctgttgacacttcccttctctgtgctttagtcaccctaccctcggtcaactcctaactcctgcctgccacagggcctttgcacatc

SEQ ID NO: 32448 - DNA, 201 bp, Homo sapiens
atgattttctccatggcctttctgataatcctttcatccttcatctcccctgtcgccgttttctttgctttgctttgcttgcttttttttttttttttttktgagacggagttttgctcttgtcgcctaggctggagtgcaacggcacaatcttggttcactgcagcctccgcctcctgggttcaagtgattctcctgcct

SEQ ID NO: 32449 - DNA, 201 bp, Homo sapiens
ataccctttaatgattttctccatggcctttctgataatcctttcatccttcatctcccctgtcgccgttttctttgctttgctttgcttgcttttttttytttttttttttgagacggagttttgctcttgtcgcctaggctggagtgcaacggcacaatcttggttcactgcagcctccgcctcctgggttcaagtgat

SEQ ID NO: 32450 - DNA, 201 bp, Homo sapiens
tataccctttaatgattttctccatggcctttctgataatcctttcatccttcatctcccctgtcgccgttttctttgctttgctttgcttgctttttttkttttttttttttgagacggagttttgctcttgtcgcctaggctggagtgcaacggcacaatcttggttcactgcagcctccgcctcctgggttcaagtga

SEQ ID NO: 32451 - DNA, 201 bp, Homo sapiens
ctaagccttctcacacctagactttagacttctggcctccagaatactaagaaaataaatttctattgttttaagctaccacacagatgcaggaaactaayataccctttaatgattttctccatggcctttctgataatcctttcatccttcatctcccctgtcgccgttttctttgctttgctttgcttgctttttttt

SEQ ID NO: 32452 - DNA, 201 bp, Homo sapiens
ggggtttcaccatgttagccaggatggtcttcatctcctgacctcgcgatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcct

SEQ ID NO: 32453 - DNA, 201 bp, Homo sapiens
tacaggcacccaccaccatgcctggctaattttttgtatttttttagtagagacggggtttcaccatgttagccaggatggtcttcatctcctgacctcgygatctgcccacctcggcctcccaaagtgctgggattacaggcatgagccaccacgcctggccctgatttttaaatttttcatggagacagggtctcacct

SEQ ID NO: 32454 - DNA, 201 bp, Homo sapiens
atggggctgactgagactggggatgttcatcacaaagtgttcaggttacatccaggctgattactggccaggagactaggcattcatagtggggcgtcctwtaaggtctgaagaggacagtgaccatccaccacaggcaaacatgtgtgtgttaaaaaggaatgacgttttggtctgtgctacaactgggatgaacctcaa

SEQ ID NO: 32455 - DNA, 201 bp, Homo sapiens
tatatgtagtctgtcattgactgaaagttgtcatgtagcccatgactgtcgtctcttttaggggaaaaaacaaaagcagaaagcaagcaagctggtatcckgcgtatctgtgagctcaggaagcagctgcatgtgcatactggataagcaagggagactccaaccccgggctctctaagggtgtaattgttgcaggcacac

SEQ ID NO: 32456 - DNA, 201 bp, Homo sapiens
catagaaatagtacagtaaaaatatgatattataatctttgggaccgccatcatatatgtagtctgtcattgactgaaagttgtcatgtagcccatgactrtcgtctcttttaggggaaaaaacaaaagcagaaagcaagcaagctggtatcctgcgtatctgtgagctcaggaagcagctgcatgtgcatactggataag

SEQ ID NO: 32457 - DNA, 201 bp, Homo sapiens
aggttgctgtgaggcaagatcacaccactgccttctagcctgggcagcagagtgcgaccttgtctcaaaaaaaaaaaaaaaaaaaaaaaaaaaagaaaaaraaaaaagttggaatgacatcagactcaaaatgtgtcacttcgcagtggggatgcaattctgagaaatgcatggttaggtggtttcatcattgtggaacat

SEQ ID NO: 32458 - DNA, 201 bp, Homo sapiens
ggcagaggttgctgtgaggcaagatcacaccactgccttctagcctgggcagcagagtgcgaccttgtctcaaaaaaaaaaaaaaaaaaaaaaaaaaaagraaaaaaaaaaagttggaatgacatcagactcaaaatgtgtcacttcgcagtggggatgcaattctgagaaatgcatggttaggtggtttcatcattgtgg

SEQ ID NO: 32459 - DNA, 201 bp, Homo sapiens
ttggagacaagcctgggcaacatggcaaaaccccatctctacaaaaaattttaaaaatttagccgggcaggcatggtggctcatgcctgtagtttcagctrttccggaagctgaggtaaggaggatcgcttgaacctaggaggcagaggttgctgtgaggcaagatcacaccactgccttctagcctgggcagcagagtgc

SEQ ID NO: 32460 - DNA, 201 bp, Homo sapiens
tcatgtctataagacaccaccatttcaaagccaaagagattgtttcaaacatatcatgctcaccccaatcaatgtgggccgcctcctccacatgaaatcamccagaaagtgattgattctgcagagccataaaccagggtctttcctattttcggcaagtggttctgtgctaaatacagtgctttgaaatttttgttcccc

SEQ ID NO: 32461 - DNA, 201 bp, Homo sapiens
tgggctggatttgtcctgtggactgtagtttgctgacatccaggctagatccttaatatacaatgaagtagtaaaacacatgtaaaagtaaaaagcaggcraaatagaataaaatacacatttgcacaccacagtatccaaaaaggttatgtactggggctaaagatttggcttggagtttcctggtagtcaaggcaaaaa

SEQ ID NO: 32462 - DNA, 201 bp, Homo sapiens
aagaaaattaacactattacgtagtattatctaatatgccctctacattcaaattttcatgtctccaatcctgccccctttggaacttctgttggtgttcratctggaatctgagaattcccttgcatttggttttcatcccccatagtcttcctttttttattttttattttatttatttatttatttatttatttattt

SEQ ID NO: 32463 - DNA, 201 bp, Homo sapiens
gtatttttggtaaagacaaggtttccccatgttggccagccttgtcttgaactcctgacctcaggtgatccacccacctcagcttcccaaagtgctgggawtacaggtgtgagccaccgctcctggcacccatcaaattttcaaaggaagaaatggaatggtgcaaccatggtacatgggaaggaggagggggacacacaa

SEQ ID NO: 32464 - DNA, 201 bp, Homo sapiens
gtttgggcactatagccttaaagtttctcctgctctttgcagatgaatgaaggggcgctttctggaatctttgtggctggggctgctgctctgcactgctrtggctctttttcacaaatgcttatggagctctaactgggggcaaggaactgtgctacggttgggaagagaggagtgggcaaaaggagacactggggcttc

SEQ ID NO: 32465 - DNA, 201 bp, Homo sapiens
aggtattgagtcagctctgtgacgccagtgcaattatcccgattcagcatcagatttattcaccattaaacatgttctaacttgattgcaaacaagccttrtattatttagagggatccacggagctggcagagggggcagaggtgtccgcaggcctcctgcccttccaggcttaatggatgatcatcttccctgctaaaa

SEQ ID NO: 32466 - DNA, 201 bp, Homo sapiens
tgaaaaaggggaagggagagggaaggaagaggaaaaagcacaaatgtgcttgtttttggatcagcccctgtactgggcacatggatgcagtcagtcctcartgtaccccaggaaagaggaaactgagtctccatgtggctttctgtctggcctttctcttttgcttgccttgtgctttgaatgcaggcctgctgtttgcct

SEQ ID NO: 32467 - DNA, 201 bp, Homo sapiens
tgttgttttcttttcacttgagtttaataaatgaaaaaggggaagggagagggaaggaagaggaaaaagcacaaatgtgcttgtttttggatcagcccctstactgggcacatggatgcagtcagtcctcagtgtaccccaggaaagaggaaactgagtctccatgtggctttctgtctggcctttctcttttgcttgcct

SEQ ID NO: 32468 - DNA, 201 bp, Homo sapiens
ggaggagttgttgttttcttttcacttgagtttaataaatgaaaaaggggaagggagagggaaggaagaggaaaaagcacaaatgtgcttgtttttggatsagcccctgtactgggcacatggatgcagtcagtcctcagtgtaccccaggaaagaggaaactgagtctccatgtggctttctgtctggcctttctctttt

SEQ ID NO: 32469 - DNA, 201 bp, Homo sapiens
gggttttccctcagcttgctggggccgtgcacctatgtgagattttattatttgtaattttgggggggttaatttcacagcttaattctggcctttatgcrtttagagctcccctcttgtgtttcagaaaggaggagttgttgttttcttttcacttgagtttaataaatgaaaaaggggaagggagagggaaggaagagg

SEQ ID NO: 32470 - DNA, 201 bp, Homo sapiens
actctgcaatgctgagtacttctcatccttcaggtctactgcaagtgtcacctggccaacacaccatgccttcccagtctctggtgttactctctgcataytgtagaccatcatcttgtttgcatacttgtctgttatctctttatcatccttctacccacatcaggcaattccaagagagaagaccactggttttgtttg

SEQ ID NO: 32471 - DNA, 201 bp, Homo sapiens
aaggcaatcaaagtctattgtcacaaggaatgggaggaacggggacgtgatctaacatttgctgagatcctgctgtataccgggaacagaacatatatggkttcatttcatcctcccattatcaccgtgaggcctcttccgcttatctattgctgagtaacaaggtgtacccctcaatttactggcgtaaaacgacaacag

SEQ ID NO: 32472 - DNA, 201 bp, Homo sapiens
tgccaggctgctctcgaactcctgacctcaggtgattcacctgccttggcctcccaaagtgctgggattacaggtgtgagccaccgcacccggcccctgcstttttattttgctaaacctgatgacccttgccatagcagaactaaagtgatgatgatgattacagcagatcagttattttgagctctgactttgcatgag

SEQ ID NO: 32473 - DNA, 201 bp, Homo sapiens
ggagctggtggcagggggagagacttcaaattgagccagacctcaggcatgaagggaggggagagagggggaaatgtggaggaagggggcgtttgtgcagkgggaagttggagaaagtacaaatgaaagcctctctgcagtgaacctcatgactgctttagagaggtgcttatgtaataactgcagtggtgtcgctttaga

SEQ ID NO: 32474 - DNA, 201 bp, Homo sapiens
aaattggcacttgtacccttgaaatacataaaactttataaaaaattaaaaagagttactgtaatgattataaaatgaaaattctacgtcatgagaaagcrttgtgccatattttcaccgggagcatttttttttccttaggggaaatgaaaaataatggcatctatgatcttagatttagtaaaacgcagtatcttcttc

SEQ ID NO: 32475 - DNA, 201 bp, Homo sapiens
ccagagtgattggtgataaaaatggaggcctacttaagtctaagagagttcttgtgaaagtgggagggggatgagggttggaaaattgcctgttaggtgcmatgttcactattcagatgatggatacactaaaagtgcagacttcaccactacgccatatatgcgtgtaagaaattggcacttgtacccttgaaatacata

SEQ ID NO: 32476 - DNA, 201 bp, Homo sapiens
cggatcatctgaggtcgggagttcgagaccagcctgaccaacatggagaaaccccgtctctactaaaaatacaaaattagccaggcgtagtggcacatgcstgtaatcccagctactcgagaggctgaggcaggagaatcgcttcaacccagaaggcggaagttgcggtgagccgagattgcaccattgcactccagcctg

SEQ ID NO: 32477 - DNA, 201 bp, Homo sapiens
agtcacaaaaattatgactccggcaccgaggtacttatctgacaaatgcaatgcgaatggtcttgttcttatcaatgagatcagatttcagaaatgaatgygaagaccgaggcgttgctttgtgcacagataaccttgcaggcgcaaactcccaaaccagaataaaagaattctctatgaaataatgggccaggaagccca

SEQ ID NO: 32478 - DNA, 201 bp, Homo sapiens
tccagcaatctgcctggtgctaatatttatataacacactcgccagactccatggcctgagtccgggggtggcttttcggggtgcagcttggatggcatcrgaacctgcaagaagccaagacgcctgttctccacggcggagcccgctggtcggtcactcctgttcctttcgtgtccgttgggtgcaggcattatttccag

SEQ ID NO: 32479 - DNA, 201 bp, Homo sapiens
ggacaggaaacacacaggggctccagcaatctgcctggtgctaatatttatataacacactcgccagactccatggcctgagtccgggggtggcttttcgkggtgcagcttggatggcatcagaacctgcaagaagccaagacgcctgttctccacggcggagcccgctggtcggtcactcctgttcctttcgtgtccgtt

SEQ ID NO: 32480 - DNA, 201 bp, Homo sapiens
tgccaggtgtgataaatgactaatcagcacgcaggagcctcagtcctcaaaggaggactattacagtgttatcagctgcgggcctgggtgtacggagcccsgaacagggatggggacaggaccttgcgctgtgcggcttggcatgctgctccagagtgagcccatggctgtctcttagttttgtcaccggcggctttatgt

SEQ ID NO: 32481 - DNA, 201 bp, Homo sapiens
tgcttgtcaagagggtaatgtgtcattaactggggactctgcctcgcctctcctctcggacatgacagtgcggctggataagagaagagtaattatagttmagcagggctgccaggtgtgataaatgactaatcagcacgcaggagcctcagtcctcaaaggaggactattacagtgttatcagctgcgggcctgggtgta

SEQ ID NO: 32482 - DNA, 201 bp, Homo sapiens
aatgctaagttggctttctccccaaaccttctaagtaggcaatcaggatttaacgacccgcaaatttccaattttttagtttatgaaaaaatatatctacrtataatttttgcctccattagagtctcatctttaaaaaaaaaaattattcagtgacttcctccctctctttccaatgaggaaaactggactatttatgct

SEQ ID NO: 32483 - DNA, 201 bp, Homo sapiens
cggaggaaagtgtcctctgagccctccttgagggacataaatagccccaaaagtcactgaatgctaagttggctttctccccaaaccttctaagtaggcartcaggatttaacgacccgcaaatttccaattttttagtttatgaaaaaatatatctacatataatttttgcctccattagagtctcatctttaaaaaaaa

SEQ ID NO: 32484 - DNA, 201 bp, Homo sapiens
atgcattagctggaaggtaacaagaggaaatcgcctgccagggtccctgactcccggaggaaagtgtcctctgagccctccttgagggacataaatagccycaaaagtcactgaatgctaagttggctttctccccaaaccttctaagtaggcaatcaggatttaacgacccgcaaatttccaattttttagtttatgaaa

SEQ ID NO: 32485 - DNA, 201 bp, Homo sapiens
agtatgcaagtgttgtatggatgtgagcgtctgcgtaggtttttatttttctctctcagaatgaaaggtttgattcgtaccagctccccatcccttcccaygatcccatcttaatgtctgttgtggaagttggcccacagaagcctcaaggctaaccaacaagaaagatcacttcatatgcattagctggaaggtaacaag

SEQ ID NO: 32486 - DNA, 201 bp, Homo sapiens
agtgagctcattttacgttgtatgtaccagtatgcaagtgttgtatggatgtgagcgtctgcgtaggtttttatttttctctctcagaatgaaaggtttgrttcgtaccagctccccatcccttcccacgatcccatcttaatgtctgttgtggaagttggcccacagaagcctcaaggctaaccaacaagaaagatcact

SEQ ID NO: 32487 - DNA, 201 bp, Homo sapiens
cccggtctctactaaaaatacgaaaaaaattagccaggtgtggtggtgggtgcctgcaatcccagctactctggaggctgaggcaggggaattgcttgaayccgggaggcagaggttgcagtgaacccagattgcgcctctgcactccagcctgggcaaaagagtgacactctatctcaaaaaaacaaaacaaaacaaaaa

SEQ ID NO: 32488 - DNA, 201 bp, Homo sapiens
ctagttactaaagatgcagcaatgaatgaaaggtaatcctgtccttgaggcattcacaggtaaagaagcctgcttgggacattgggccgtgagctccaacratgtcactattcttctaggctttgtggacctttggtcaccccttctgtaagaccaactcccttatctgcctgtacagtgttctgcgaatcccggtctcta

SEQ ID NO: 32489 - DNA, 201 bp, Homo sapiens
ttctccctctccccactttcaggctctcctttcacacgcatgcattaattcgttcattcttggaatctacccacctgtgatgtgctagttactaaagatgyagcaatgaatgaaaggtaatcctgtccttgaggcattcacaggtaaagaagcctgcttgggacattgggccgtgagctccaacaatgtcactattcttct

SEQ ID NO: 32490 - DNA, 201 bp, Homo sapiens
cagggggttgggaaactcacctgaaggatcttctccctctccccactttcaggctctcctttcacacgcatgcattaattcgttcattcttggaatctacmcacctgtgatgtgctagttactaaagatgcagcaatgaatgaaaggtaatcctgtccttgaggcattcacaggtaaagaagcctgcttgggacattgggc

SEQ ID NO: 32491 - DNA, 201 bp, Homo sapiens
tattcattagtggatgcaggggcgaaatgaaactcagggggttgggaaactcacctgaaggatcttctccctctccccactttcaggctctcctttcacaygcatgcattaattcgttcattcttggaatctacccacctgtgatgtgctagttactaaagatgcagcaatgaatgaaaggtaatcctgtccttgaggcat

SEQ ID NO: 32492 - DNA, 201 bp, Homo sapiens
acctcagtttcctttcctatacaacgcaagccataaggttaacccctcctcgtggtgatgttaagatgaaacaggaaggtgaggggcttaacacatttccstgttcccataagctttcaggagatcttggtagttttcatctcggtcttcattaccatcatcactgcttcagactcctgtccatgtggggccctgtggtct

SEQ ID NO: 32493 - DNA, 201 bp, Homo sapiens
ttaccaccctcccacttttggcaatgagacagcaagcttggaatttggagtccatgttaaatccaggtcccagccaggcacagtggctcacgcctgtaatyccagcattttgggaggctgagatgggaggatcacttgagcccaggagtttgaggccagcctggtcaacacaaggagacttcatctctataaataataaaa

SEQ ID NO: 32494 - DNA, 201 bp, Homo sapiens
gagggcggtgagatgctgagagtaatggggctggcccaggaggaagtgagaggaagcaaagtgagacagaggtggtgtgtgagcgtgtgtttgtgtgtgtktgtgtgtgtgtgtgtgtgtgtgtgtgtgattgagagagagagagacagatggagggaaagagaggcgggggattccaggtacagtggctcatgtctgtaa

SEQ ID NO: 32495 - DNA, 201 bp, Homo sapiens
taaatactgagactgagcagtcttgtggattcaggaattgggcatccagttgggaccctttgcaagaagggtgttagggagcagagagcatgagtaagccrgaagcagagcaggagagagaatggagcaggtgtgcaaagagggcggtgagatgctgagagtaatggggctggcccaggaggaagtgagaggaagcaaagt

SEQ ID NO: 32496 - DNA, 201 bp, Homo sapiens
agtttgattagttcaatatcaagagctaaatacattagcttatatatatgtctgatgaactcatctttgcttccttggatccccaagatagaatggccctratgcagtcaaaccaccctgcagaatcttaacagcaccacaaatattgcatccaggcatcctgcccatgctggcttgcaggctggggatccctgtccatag

SEQ ID NO: 32497 - DNA, 201 bp, Homo sapiens
atttagagttctgaagatgctgaacccttattgtatctccccagggttagtgagtaattgggaatagtgttccatcttggatgcccccatccactaaccakctttcctcttcgggtggttctaagaattctaattcaattagaaggccttctttttagtttgattagttcaatatcaagagctaaatacattagcttatat

SEQ ID NO: 32498 - DNA, 201 bp, Homo sapiens
gagaatcacttgaacccgggaggcagaggttgcagtgagccaagatcacgctattgcactccagcccaggcaacaagagcaaaactctgtctcaaaaaaawtaaaaaaaaaaaaaaagaaagaaaattaatttctcagaggtagtaataggggtggctgtcaccatccttggccaaggagagggagcagatactggagaca

SEQ ID NO: 32499 - DNA, 201 bp, Homo sapiens
tgcttacaacatgattccggtgaaaccacaggtctcgtcatgtcccttctgtatccatggtagtcccagtgggaaagaggtaacaaacccaaattgagtamtttcaagaaattttaataacaaaggggctattttataaagggggggtggtcaaggtgtagggaaacataaaagagagcgaatttctggtctggtgctgtg

SEQ ID NO: 32500 - DNA, 201 bp, Homo sapiens
cacacatacattcctggttctgtcagcatttccctaggcgagatgagtcacacatttatatttttacatatgcagcgcgcttgcaattttccactggggawgatagaaaaacttattgaaaatagttaatcagttttacaaagatgccataggtagaggtgcttccagacctatagttttgaaagtcacctagaggatacc

SEQ ID NO: 32501 - DNA, 201 bp, Homo sapiens
gtccccgtgccatgaatcacttcacatctctggctagtacagatctctccctgtcactagtggaagtcgcctgcactacattcagaataggggccaggcgyggtggctcacgctgtaatcccagaacgttgggaggccaaggtgggaggatcacttgaagtcaggagtttcagaccagcctgacaaacatggtgaaaccca

SEQ ID NO: 32502 - DNA, 201 bp, Homo sapiens
gtgatctgcccgccttggcctcccaaagtgctggcattacaggcatgagccatcgcgcccggccagagggctattctttgtcttttatttgctttgagtcyggtataaccatgtggcacatacccctgtacatgtttgccaagactgctatatggtagagcttggaattcttaggagctttatcaggtaattgcaagtccc

SEQ ID NO: 32503 - DNA, 201 bp, Homo sapiens
ctattctttttttttttttttttttttttttgtgagatggagtcttgctctgttacccaggctggagtgcagtggtgcagtctcagctgactgcaagctcygcatcccaggttcacgctattctcctgcctcagcctcccgagtagctgggactacaggcgcctgccaccatgcccggctattttttttgtatttttagta

SEQ ID NO: 32504 - DNA, 201 bp, Homo sapiens
tgaagcagtccatctgttatgagagctattctttttttttttttttttttttttttgtgagatggagtcttgctctgttacccaggctggagtgcagtggygcagtctcagctgactgcaagctccgcatcccaggttcacgctattctcctgcctcagcctcccgagtagctgggactacaggcgcctgccaccatgccc

SEQ ID NO: 32505 - DNA, 201 bp, Homo sapiens
gtgactttgagacatatctcctacagcaggtggagttagcttaactaatgcagaacgataggactggtgaagcagtccatctgttatgagagctattcttyttttttttttttttttttttttgtgagatggagtcttgctctgttacccaggctggagtgcagtggtgcagtctcagctgactgcaagctccgcatccca

SEQ ID NO: 32506 - DNA, 201 bp, Homo sapiens
taaactctgcatgtggtctccatgatgtcctggctgtgttagcatcagaaatggctttgcccacatctcccaactctgccctcttattaggatttctctgygctggctgatgcctgagccatctaatgatctttacgggaataaccaaaaatgctgggtggggggggaaaacgccagcagatctctttagggcagagtagg

SEQ ID NO: 32507 - DNA, 201 bp, Homo sapiens
tcaggagattgagaccatcctggctaacatggtgaaaccccatctctactaaaaatacaaaaaattagctgggtgtgttggtgggcacctgtacttccagstgcttgggaagctgaggcaggagaatcacttgaactcagaaggccaaggttgtagtaagctgagattgcaccactgcactgcagccttggcaacagagcg

SEQ ID NO: 32508 - DNA, 201 bp, Homo sapiens
gcaggctgcacaggaagcatagaagcttctgctactgggggcgcctcaggaaacttataatcatggcagaaggtaaaggggaagcaggcacatcttacatsgccagagcaggagcaacagagagcgactggggaggcgctacacacttttcaaccaccgaatcgcatgagaactctctcactgggacaacaccaaggagat

SEQ ID NO: 32509 - DNA, 201 bp, Homo sapiens
gatgctgttcatttgccttattcgttatgaccatagaagtttgtggggtggcactctttattctgtcctcgccccgcaagcaaagcacacaccacaagctrtaaggagatgagctcagtaggcctgtcctttactttattttccctattagaatcccaccatagacgccctctctgcatgtgtccttgtctgggggagtcg

SEQ ID NO: 32510 - DNA, 201 bp, Homo sapiens
cctccagatgctgttcatttgccttattcgttatgaccatagaagtttgtggggtggcactctttattctgtcctcgccccgcaagcaaagcacacaccasaagctataaggagatgagctcagtaggcctgtcctttactttattttccctattagaatcccaccatagacgccctctctgcatgtgtccttgtctgggg

SEQ ID NO: 32511 - DNA, 201 bp, Homo sapiens
tggtgtttgtcagagaggttcgagctcttaaatttaaatggcctcccacagggaagcagaagtccttttggatcctccagaggactgagatcctccagatsctgttcatttgccttattcgttatgaccatagaagtttgtggggtggcactctttattctgtcctcgccccgcaagcaaagcacacaccacaagctataa

SEQ ID NO: 32512 - DNA, 201 bp, Homo sapiens
tcaaaggctgggcctgatggtgtttgtcagagaggttcgagctcttaaatttaaatggcctcccacagggaagcagaagtccttttggatcctccagaggmctgagatcctccagatgctgttcatttgccttattcgttatgaccatagaagtttgtggggtggcactctttattctgtcctcgccccgcaagcaaagca

SEQ ID NO: 32513 - DNA, 201 bp, Homo sapiens
gcgtttagccagcgccccgctctgggctccagcaacattagggcattgttattccatccgaatgacaatttcaagctcacgtctttgttgtccatcctcgwatatcctgcaccgttcctggcacagagtaggcactggataattatttcttggatgaaagaatgaacaaatgaatgaatgaatgaaagtttttttccttgc

SEQ ID NO: 32514 - DNA, 201 bp, Homo sapiens
tcattatggccccctcccccaggagccttttgagatacgactttcctaatggtctttgcccatgaaatctgaataccacagatgtgctgaatgcctgttcrtgtaccatatacacatggtatatgcctcgtaaatgaaagggtgaacagtgtttattccccaactgtcgtccctcaaaaccaatgttaacacccctggatg

SEQ ID NO: 32515 - DNA, 201 bp, Homo sapiens
gcctagttatgatgtgatgaatccgtctctgttaaggttatcaactttaataaaccatgtattatttccttaaatattgtgcaatgtgcagggaattattkcagttttgttttttatttagcacaaacctaaatattacacgtagcaaatgtcacccgatgcaactgtctgtcctgaagaggaggacagattattctgtgg

SEQ ID NO: 32516 - DNA, 201 bp, Homo sapiens
agcacaaagcaaagcagttaaatgaataaccgccttccagtacagataataaagcaggagaattttgtgtgtcacatcaataaacatcttaattgaacagyacgtgggttcttccctagtacctgccttgctatacactagccttggaaagagtcttggtaaattgttcagcctcaagttccacaacaaaatgggattctg

SEQ ID NO: 32517 - DNA, 201 bp, Homo sapiens
tttggatttgtgttagagaaaaactgtctctaatgaccgcacagcacaaagcaaagcagttaaatgaataaccgccttccagtacagataataaagcaggrgaattttgtgtgtcacatcaataaacatcttaattgaacagcacgtgggttcttccctagtacctgccttgctatacactagccttggaaagagtcttgg

SEQ ID NO: 32518 - DNA, 201 bp, Homo sapiens
gtaaggcaagagacccgtaattgattcataagatcccttcctccgatcgcattgaagagttaattatttttcctgcagttgggactcagctgttgtttccmctgggattaaacagctgtcagcattgttaatgacatcaaattcatgcattaaaatcctctcattcccttcccgtataaggtggggttgcggaaatctctg

SEQ ID NO: 32519 - DNA, 201 bp, Homo sapiens
atagtcactggaaggaagtcagcaagcaggggtgaaaaaaaaaaaaaataaaagaacctgaagccgccaagagaggctcactgaccatctctgggggaggragggtgaagagtagcaaatttaccgtcatcagcaggtgtgtaaatgttccatttacattgaatggcacatgtcataaagtacataccgctgcacatccca

SEQ ID NO: 32520 - DNA, 201 bp, Homo sapiens
aatcaaaaaagccagtcacaaaggaccctatgttatatgatttcatttacatgaaataccccaaagaggcaaatctgcagaaacagaaagtagagtggttkccaggggctggggatggggtgtggatggaggcatttgggattaacagctaaagatagcaggattccttctaaagcaataaaaatgttgtaaagttgattg

SEQ ID NO: 32521 - DNA, 201 bp, Homo sapiens
ttcgcatgttgaaaacattgtactaatcaaaaaagccagtcacaaaggaccctatgttatatgatttcatttacatgaaataccccaaagaggcaaatctrcagaaacagaaagtagagtggttgccaggggctggggatggggtgtggatggaggcatttgggattaacagctaaagatagcaggattccttctaaagca

SEQ ID NO: 32522 - DNA, 201 bp, Homo sapiens
tggagataaattgtcattgctaattgccagagaccaggtcctggtggtagccaaactgttccctagggagttctcaccaaccttgcaaaatgagatggcartcttcatcgtggatgcaattatgtttcattgttaaccatcacaagcaacgggacattatgatgactgttataagttggtttcacatgtaaactttgacct

SEQ ID NO: 32523 - DNA, 201 bp, Homo sapiens
caggacctgacttaggaggactcagaagctggagactgcagaggatggcacagagttccaaatctttggggtgtgtaagagtaggagaggcaggatgggaraggatgggagtgatgccacataaatcaactctgttgcagcctccggggccacatcagtagctgcaggaggaggagggaacagggagacagggagcctttc

SEQ ID NO: 32524 - DNA, 201 bp, Homo sapiens
ttaggttcccacaggatgaaggatcaccatgaacggtcaggacctgacttaggaggactcagaagctggagactgcagaggatggcacagagttccaaatmtttggggtgtgtaagagtaggagaggcaggatgggagaggatgggagtgatgccacataaatcaactctgttgcagcctccggggccacatcagtagctg

SEQ ID NO: 32525 - DNA, 201 bp, Homo sapiens
gagtgcagtggcatgatcatggctcactgcagcctcccgggctcaagctttccacccacctcagcctcctgagttgctgggaccacaagtatgcaccaacrtgcctggttaatttttgtggttttttttttttttttttttttcctgctgagatggggatttcaccatgttctccaggctggtttcaaactcctgagtcca

SEQ ID NO: 32526 - DNA, 201 bp, Homo sapiens
ccaagtttacctgcctctctgagaagcccatcagccctgagagatacctggaaggaaagaggaaaatgcgggattcaaatcatgttgcaagtggatgaatytagccccaaacaactgggaggcaactactcctgcctgccgaggccttttttttttttttttttttttgagactcactctgtcacccaggctggagtgcag

SEQ ID NO: 32527 - DNA, 201 bp, Homo sapiens
gttatctgatatgtgtttcagcctgttttcccaagtttacctgcctctctgagaagcccatcagccctgagagatacctggaaggaaagaggaaaatgcgkgattcaaatcatgttgcaagtggatgaatctagccccaaacaactgggaggcaactactcctgcctgccgaggccttttttttttttttttttttttgag

SEQ ID NO: 32528 - DNA, 201 bp, Homo sapiens
ggttatctgatatgtgtttcagcctgttttcccaagtttacctgcctctctgagaagcccatcagccctgagagatacctggaaggaaagaggaaaatgcsggattcaaatcatgttgcaagtggatgaatctagccccaaacaactgggaggcaactactcctgcctgccgaggccttttttttttttttttttttttga

SEQ ID NO: 32529 - DNA, 201 bp, Homo sapiens
tcttttctcttctagaactttccccatagtcatgcatctgtccctgggttatctgatatgtgtttcagcctgttttcccaagtttacctgcctctctgagragcccatcagccctgagagatacctggaaggaaagaggaaaatgcgggattcaaatcatgttgcaagtggatgaatctagccccaaacaactgggaggca

SEQ ID NO: 32530 - DNA, 201 bp, Homo sapiens
tcctttcttttctcttctagaactttccccatagtcatgcatctgtccctgggttatctgatatgtgtttcagcctgttttcccaagtttacctgcctctytgagaagcccatcagccctgagagatacctggaaggaaagaggaaaatgcgggattcaaatcatgttgcaagtggatgaatctagccccaaacaactggg

SEQ ID NO: 32531 - DNA, 201 bp, Homo sapiens
cgttgtgtctggtacatggtaaggggttcgtaaatactgagttatttcttattaacatttattattgtctccactggaagaagagcctgtagaatatgcaractattcaaatgcttcctttggtccattgttgtcctttcttttctcttctagaactttccccatagtcatgcatctgtccctgggttatctgatatgtgt

SEQ ID NO: 32532 - DNA, 201 bp, Homo sapiens
gagaggattccttgagtccgggagttgaagaccagtctgggcaacatagtgaggccttatctcttcaaaaataaaaaaaattagctgcccatggtggtgtrtgcctgtggtcccagctacttgggcagctgaggcaggagaattgctggagtacaggagattgaagctgcagtgaactgtgactacactgctgcactcaac

SEQ ID NO: 32533 - DNA, 201 bp, Homo sapiens
tgtaagtactctgatatgcaccacctagattctacaattaacatttccctctatttgcatctctatccatttaccattcctcttgtctatccatcagtctrtcttgattcatttcaaaataagttgtaggtcaggtgcagtggctcacacctgtaataccagcattttgagaggcagaggtgagaggattccttgagtccg

SEQ ID NO: 32534 - DNA, 201 bp, Homo sapiens
cctattgccttcagatttacatcaagcacaatttggcaggtattagggatggacccagcagccaagtctttgttgccttaaacagatcccttgtctcttgycaggacctccttccaggctgctcctgagcaagtctggatgtgacttctacctatgatccagtgggttgggccataaaggagctttggaaagggacagtct

SEQ ID NO: 32535 - DNA, 201 bp, Homo sapiens
gatgtatggatgggtgggttggtgggtgcatggatgggtgagtaaggggggataaatgaaaggcttgttcttctgaagggactctttacaaagagtctttsatcttccagcttcacgtgcaagagaatccccaaggtgagcttgttaaaataagcatattctgggtatcacttcctgattttctggttcagtaagtctgag

SEQ ID NO: 32536 - DNA, 201 bp, Homo sapiens
atggataggtagatggatggatgcgtgggtgtgtggaatggtgggtggtaggtgggtacatagatggatgtatggatgggtgggttggtgggtgcatggaygggtgagtaaggggggataaatgaaaggcttgttcttctgaagggactctttacaaagagtctttgatcttccagcttcacgtgcaagagaatccccaag

SEQ ID NO: 32537 - DNA, 201 bp, Homo sapiens
taaaaggtctatgcagattaacgaggaaaaatgagggaaattactgtaaggtttttaaaacatgatagttatatatgaactgatgattatataattgaacrtgcctaaattgatgtagttctctgtaaaactagttggtgtaaggaaacttggtctttgaccatcaaggaggttgcagtttgtggcatggcacaaagataa

SEQ ID NO: 32538 - DNA, 201 bp, Homo sapiens
aaggttctcacagtctggagggaacagagagccatcagggacaataggtccctgtgccatcagctactgggatgtatgactttccagtagaggtacacagmacttgttccaaaaggagcctatgtagctttgggagttctctatttagtcaccttattttttttgtcttcttgttaaactagcatcctgttttactgaatc

SEQ ID NO: 32539 - DNA, 201 bp, Homo sapiens
catggttggggtagtgggcacaggggaaggaaggttatgtaattttaaaattcttcctttgattcaaaagaaaaaaacatgtttgttgcattcaactccawagggtgagcatagcttagtggggagagatttggactaaaaaataagagttctgggttcaagatctgaggtaaattatttgctaggccttagtttcccatc

SEQ ID NO: 32540 - DNA, 201 bp, Homo sapiens
tgccttgcagtttccaaagtaagctgaacagtgttttttaacagtgctgcccctctctcccactagaaatgcgagtccatccttttaccaagtgtggtacracaaaggtttctctggttttcttttggtattctcagacaactgaaatataaattacatggtatgtgcaggtatcaccaggatgcaattagtttgatgaaa

SEQ ID NO: 32541 - DNA, 201 bp, Homo sapiens
taatctcaaagctgtccctgcgctggtgcggctggcccacttgtgcctttgtgaatttgcagagaagaggctgggcgtggggggacacatgactaatccgscctttcttttgtttgtgcaacaactcaattcactgtcaccacatcagcacatttgctgcaaatctcagtgccctctcactttcgttttatttaatgcgtt

SEQ ID NO: 32542 - DNA, 201 bp, Homo sapiens
ttatgaaacctcttttaactttattttttatattttttttattttcttgtttctttttatttttaaaatttatttttgttttttttgttttgagacagggycttgctctattgcccaggctggatggagtgcagtggcccaatcatggcagcctcagcctcctaaactcaagcagttctcctgcctcagcctcccgagtag

SEQ ID NO: 32543 - DNA, 201 bp, Homo sapiens
tgttgcccaggctcatctcaaactcctggcttcaagtgatccttctgcattgtcccccacaaagtattgggaatgtattctttcctgatcaggaaactccrcagagagaaagtgacagttgaagactatattgaattttggcccacaggaaaaggaaactttgctgttagggtcagctggaggagagactgcaggggtcag

SEQ ID NO: 32544 - DNA, 201 bp, Homo sapiens
ggatgattggatggatgatggttgagtgagtgggtggatggataggtggaaggatgaatggatgcatggctgagtggatagaaggtggatggatggagggrtggatggttggatggttggataattggatggatgcatggatgtttgggtggatgaacagatgaatggatgcatggatgaatgagtagttggatggatgga

SEQ ID NO: 32545 - DNA, 201 bp, Homo sapiens
ctgctctcatcacctggtttcaaagtcgagccagacgttctgtctcagctcagattctacctaccctgaggttcgcagctgggcatgatcgagccactctmcactctcctgtagcatttttgggctttgagtttatttgacacttttcacttgctgccttatattgcgtttatttttattaattacttcagtagtcattta

SEQ ID NO: 32546 - DNA, 201 bp, Homo sapiens
gcttcccaaagtgctgggtttacaggtatgagccaccacacctggcctgtttttgtgtttgtttattaattcctatttttcccacctgacagtacgctccrtagggcatgtgtttgtttcggttccccaacgtatccctactgcccagcagaaggcttagctgttaacaagtgtttattgaatgagtaagtgaatgagtac

SEQ ID NO: 32547 - DNA, 201 bp, Homo sapiens
tccagcaggggccattgtttccttccataatatttttaaactgtagcaaagtgatctttttgagacccaaatgtgagtatgccattctaatcttcccaccytcagataaaccacagcaatgattttatactgtctgtagggtaaagacagacccctaatcataacctacaatccctcgacccagtgacctagcccccgtgt

SEQ ID NO: 32548 - DNA, 201 bp, Homo sapiens
tacattgtctagtgggagaaatctccgttgtagattctgacatgtcactccacatctttgtaactttttatggctctcagccctactttcttaatagtagyagcagtatttatctactgtttattgtattccaggtaaaggatatgcgaagcacttttcatgcattatttaacctagctataatactcccatttgacagat

SEQ ID NO: 32549 - DNA, 201 bp, Homo sapiens
tctaccttgcggggcaaacacaacaagtaaaaggttttcctcttgaaggattgaacgcctcaatgcgtgcatcctacattgtctagtgggagaaatctccsttgtagattctgacatgtcactccacatctttgtaactttttatggctctcagccctactttcttaatagtagcagcagtatttatctactgtttattgt

SEQ ID NO: 32550 - DNA, 201 bp, Homo sapiens
tttagtcttttggttttttctctcttttggtttgttggcttatgttcgctgcttgatctgactactggttttatttctaaggatttttttttaagttggcrtctttttttctttgactttccttgtatgcccccctttctcccctgcattgtcttgcttcattcatttctttccaggttcctgcaaattgtttttatttag

SEQ ID NO: 32551 - DNA, 201 bp, Homo sapiens
gacagagtgacaccctgtgtcaaaaaaagaaaaagaaaaagaaagaaaaagctttgcctgtatatgtagaacaaatgaaaaccaaataacagtggcaccakttcttctttcagtttccatggaatatcaagcacgatttgagttgagcaatttgatttgattgatcttcttaaatgtataatctcaaactttacaataaga

SEQ ID NO: 32552 - DNA, 201 bp, Homo sapiens
accctgggtgacagagtgacaccctgtgtcaaaaaaagaaaaagaaaaagaaagaaaaagctttgcctgtatatgtagaacaaatgaaaaccaaataacartggcaccagttcttctttcagtttccatggaatatcaagcacgatttgagttgagcaatttgatttgattgatcttcttaaatgtataatctcaaacttt

SEQ ID NO: 32553 - DNA, 201 bp, Homo sapiens
cagtcctgggaaacaaacaaaatagagggcgatggctccactctgtgtggccccgtcaatggcctggacgcagctgaaaaaatccagaagagtgtaggacrctggaaaagtagcagggtgtgcgattgcagggatgggaccagcagtaaaaggtagccctgccaagaccattaagcttcctgcaactccttctggatccca

SEQ ID NO: 32554 - DNA, 201 bp, Homo sapiens
agacagaagaaaaattgattcccgtagctctctgggcagtgggatgggggtaaagcaaggaattaataaaaacccaccagaatacattatttcagacaatsaaggagagcgttacattttaaaggtacttcatctcagaaagtttgagacatacttttcacacgtggcatgaagagaaaatggaatggaatgagcactaat

SEQ ID NO: 32555 - DNA, 201 bp, Homo sapiens
ttctaacacggaagcgccctccttttctagtagcttggatgtgattggtatggagaagcagagtgggtgcgtctttgtgtgttcttgacatagttaaagartttggtatagtcaattccctttaaagtagtaggcttcttaaataattctagttgttcctcgtgctgccaagccatcttgaagaatttttcttcatttgta

SEQ ID NO: 32556 - DNA, 201 bp, Homo sapiens
ctgataggtagttactctttagtatgcccaagttcaaattacgtatgactgtgattctaacacggaagcgccctccttttctagtagcttggatgtgattkgtatggagaagcagagtgggtgcgtctttgtgtgttcttgacatagttaaagagtttggtatagtcaattccctttaaagtagtaggcttcttaaataat

SEQ ID NO: 32557 - DNA, 201 bp, Homo sapiens
atcccccctactcacaggaaagaagaaattctcaggtttcctttcccaggtttgaaaaggcagttaatcgccttacaatgaaattatatttttaaaaaagktatcataatcaaataaaagaagtacttcatgtaagtcaaggattgtgcttttactactattttttctttttttgtaatcatggtggttctttttgcccac

SEQ ID NO: 32558 - DNA, 201 bp, Homo sapiens
caaagaaagccctggagacagagcgttagccgttgctcctcgtaagcgcatcattaccttcctccgaacaaagtcctttttttttttttgtcagtagaggrtgaaaacattattggattcaggagttcatagtagtcctgtatgaagctggggacggggggatagagttatgaaatggaccatttcaaatggcattatctt

SEQ ID NO: 32559 - DNA, 201 bp, Homo sapiens
tcctcttctagaaagcgttcttgcagttagattaacaagcagatatactgaactggtgcatgaatgaataggaaatatcccagttgcaaaggataaatctrtcatgtagtggagagcgtgttcaggcaaaacatttggttctgcggtcgcttggaggattgggcccgtgctataattaatgccactagcagtaaaaggaca

SEQ ID NO: 32560 - DNA, 201 bp, Homo sapiens
tatcacttttcccttgttatgaccagaaagactcacagccatgaatttcactgaagtttatgattggtccctgattgcctcacatcttgcaaagaatcctyttctagaaagcgttcttgcagttagattaacaagcagatatactgaactggtgcatgaatgaataggaaatatcccagttgcaaaggataaatctatcat

SEQ ID NO: 32561 - DNA, 201 bp, Homo sapiens
ttttgagaggagtgtgaaatacatgaaggcaggacttccacacacctggacgtgaactagaggtgaggtggggaaagacaggaagtagatcagtgttgccyagaccctaccttttccaactagggtgtggaccatccttcagagcttggcctccaagttggaacccgtgtataccactgacagtgtttcctgggatggtga

SEQ ID NO: 32562 - DNA, 201 bp, Homo sapiens
aggctggtctcaaactcctgagttcaagtgatctgccttgcttggcttcccaaagtgctgcgattacaggcatctgccaccgtgcccagctatagagcttyatttatttatttatttatttatttatttatttatttatgagacaaggtctcactctgtctcccaggctggagtgtagtggcatgacctcggcttactgca

SEQ ID NO: 32563 - DNA, 201 bp, Homo sapiens
ctcactaataggtgggaattgaacaatgagaacacttggacacaggaaggggaacatcacacaccggggcctgtcgtggggtggggggaggggagaaggawagcattaggagatatatctaatgtaaatgacgagttaatgggtgcagcacaccgacatggcacatgtatacttatgtaacaaagctgcacattgtgcaca

SEQ ID NO: 32564 - DNA, 201 bp, Homo sapiens
aaaaccaaacactgcatgttctcactaataggtgggaattgaacaatgagaacacttggacacaggaaggggaacatcacacaccggggcctgtcgtgggstggggggaggggagaaggatagcattaggagatatatctaatgtaaatgacgagttaatgggtgcagcacaccgacatggcacatgtatacttatgtaac

SEQ ID NO: 32565 - DNA, 201 bp, Homo sapiens
tgggaggccaaggcgggtgcatcacttgagcccaggagtttgagaccagcctgagcaacatggtgaaaccccatctctacaaagaatacaaacattagacrcttttcaaaagaagacatttatgcagccaacagacacatgaaaaaatgctcatcatcactggccctcagagacatgcaaatcaaaaccacaatgagatac

SEQ ID NO: 32566 - DNA, 201 bp, Homo sapiens
tccaggaggtcaaggctgcagtgaactgtgatcacgccactgcactgcagcctgggcaacagtgcgaaaccctgtatcaaaaaaaaaaaaaaaaaaaaaargaaacacaacttaccaaaccaagaaacttacagagaacatgattagaagctagcatctgtttttaccctaccctcttcccctatgacccaccaccacgca

SEQ ID NO: 32567 - DNA, 201 bp, Homo sapiens
ctcgcacctgtaatcccagtgctttgggaggccaaggtgggagaattacttgaggccaggagtttggggctagccgaggcaacacatagagacaccgtctstcaaaaaaatttaaagaaacttagccggggccgggcacggtggctcatgctggtaatcccagcactttcggaggcctaggtgggcagatcacaaggtcag

SEQ ID NO: 32568 - DNA, 201 bp, Homo sapiens
aaagtcaagatgttgacataacagttctgaagaccaaggtggtggaataggttaggttaggatacgtcggaggagccagtgtgaactgctcctttaagacrtgaattagcccattttcatgctgctgataaagacatacccgagactgggcaatttacaaaagaaagaagtttattggacttacagttccatgtggctggg

SEQ ID NO: 32569 - DNA, 201 bp, Homo sapiens
aggagactctttgaacacttttttaaaaggcaagatgttggcctggcgtggtggctcacgcctgtaatcccagcactttggcaggccaaggcgggtggatsacctaaggtcaggagttcgagaccagcctgaccaacttggcaaaacccagtgtctactaaaaatacaaaaattagctgggcatggtgtcacatgcatgta

SEQ ID NO: 32570 - DNA, 201 bp, Homo sapiens
caaatcgaaagcatcagttgctacccctgagcaccatctcccataggagactctttgaacacttttttaaaaggcaagatgttggcctggcgtggtggctsacgcctgtaatcccagcactttggcaggccaaggcgggtggatcacctaaggtcaggagttcgagaccagcctgaccaacttggcaaaacccagtgtcta

SEQ ID NO: 32571 - DNA, 201 bp, Homo sapiens
tgatttttttttttgtatttaagttttctagcagttctcttttttaagagcctcaagtgtccaataaaaagcaaatacttgaattttcagtttctatatastgcatattttttctcctgcttgccttatttttataacagtgatttataaagacattactaaagaataggaaagaaggattttgaagaggaactgctatat

SEQ ID NO: 32572 - DNA, 201 bp, Homo sapiens
ctttaaatctaaattggagagaaggaaggtaattaaggcataattatcagacttaatcaagcacttatttattgagcttacttggtgcctgggcttgtatsttttgtttctgatttttagtttcgtttcattgctccagcgtgggggaatttgcctgtgtatccttgaataaatgtctttctttggaaggcagattaagta

SEQ ID NO: 32573 - DNA, 201 bp, Homo sapiens
gtttcagctacctgggaggctaaagtgggaggatatcctgagcccaggaggtggagattgcagtgagccatgctcgtgccattgcatttcagcgtgggtgwcagtgagaccctatctcaaaaaaaaaaaaaaaagttcctaagaaaataaagcctggcccatgcaatttgaatgtaactgtctataatttctcttggttac

SEQ ID NO: 32574 - DNA, 201 bp, Homo sapiens
gagaccagcctgggtaacatggcaaaaccttacctctcaaaaatttacaagcttagccaggcatggtggtgcccacttgtggtttcagctacctgggaggytaaagtgggaggatatcctgagcccaggaggtggagattgcagtgagccatgctcgtgccattgcatttcagcgtgggtgacagtgagaccctatctcaa

SEQ ID NO: 32575 - DNA, 201 bp, Homo sapiens
tgaggaaaataacccctcaactgcccggatgataaacacagagttctaaaatggcaacaaagggagatccacccttctcagttattgtttgaaaggacagytctcaggcaaaatatgtccacgaagttccatggaataattaccttccttggtgttaaaaaatgccctcacatttcaaacatgtcctgctttaagttccca

SEQ ID NO: 32576 - DNA, 201 bp, Homo sapiens
gagtaaccattaataccttgaataagtttataatctggtcattctgtagagcttcctatatgatgtcttctgtttaagtatttctgtaataccttatagayatctcttttagactactagtgattgttggtgtcaacatatgtgtgaaaatgcatatatcctttattaggctctagcacacagtgtgctctcaatgtttgt

SEQ ID NO: 32577 - DNA, 201 bp, Homo sapiens
tgtatttttagtagagacggggtttctccatgttggtcaggctggtctcaaactgccaacctcaggtgatctgcgtaactcggcctcccaaagcactgggrttacaggcttgagccactgtgcccggccatctttctttttcttcctctccttctaccttgcccaccatggcttaatttcaccagaatatcatcattatca

SEQ ID NO: 32578 - DNA, 201 bp, Homo sapiens
cgagtagctgggattgcagggatgtgccaccatgccaggctaattttgtatttttagtagagacggggtttctccatgttggtcaggctggtctcaaactsccaacctcaggtgatctgcgtaactcggcctcccaaagcactgggattacaggcttgagccactgtgcccggccatctttctttttcttcctctccttct

SEQ ID NO: 32579 - DNA, 201 bp, Homo sapiens
gcccaggctggagtgcaatggcgcaatgttggtccacctcaacctctgcctcttgggttcaagtgattctcctgcctcagccttgcgagtagctgggattrcagggatgtgccaccatgccaggctaattttgtatttttagtagagacggggtttctccatgttggtcaggctggtctcaaactgccaacctcaggtgat

SEQ ID NO: 32580 - DNA, 201 bp, Homo sapiens
gacaagtaccagatgtgaagcttctattgtcctctacccatgacatcaggacagaatacttttctactatctatgtgtggcagtatgcatggaatattgtsagacagagaaactcacctgagcctctgtgttcagagtatttattgggtcttcgttgcgtaggtgtgattgggtgattgcccacatatttgatctcagcct

SEQ ID NO: 32581 - DNA, 201 bp, Homo sapiens
cttgattcatgtcttggaaacactcctttgtctttcagagaaagtaaagagtgatggagacagagagagaaagtgtgacctactttttattatcagcaccrtttcatctgcaaaacacgacttttctcttcttgttacgctgagcatgaaaataaaatgttttccaaaagacctggctttggctgttgtgaggaaggccag

SEQ ID NO: 32582 - DNA, 201 bp, Homo sapiens
caggctgcaaaatgcttgttactattttgtgtattcctggcaggatttgtattcttagttttattactaatgataataacagttaatgttgaaatcagctycatcctgaaagcactgcatccattatcttattctagtctcaggccctggaggaattttctctcactatacccatttcagaaattccagaattaatgctcg

SEQ ID NO: 32583 - DNA, 201 bp, Homo sapiens
ttagctgccagagagcagggacctcatctgtcctgtccactcatgtcttcagcacttagaacagtacctggcatataggatgagcttcagaaatatttgcmggtgagtgaatgagggagtgaatgaatgagggatttgcagcttgaacgctgtactttgaaacagttccagattcatgaaatttctttttaatgcagaaga

SEQ ID NO: 32584 - DNA, 201 bp, Homo sapiens
cttctcaacctgacctgtaaaaacctgtcttgcaaaaccctcacggctctttcccctgcagtcttgatgtgaacaagcatgatgatgttggaagccatacrcaagctggatagagccagggtccctgagttcaccacccagagcaaagtcacttgtcgatcagaaatacagaactagttttggacttgatgtgagaaatct

SEQ ID NO: 32585 - DNA, 201 bp, Homo sapiens
gctcaatttagcctttccatcatgtttacatatttcaaaataatgtgttgtgcacaatatatatgtgcaatttttgtcaattaaaaataaattaaaaaaawtaaaaaatggctttcccacagcctgtcgacttccatccccatgtgtggctctccccagggcctcccttcttgttctccccagttgcagacctcagacagg

SEQ ID NO: 32586 - DNA, 201 bp, Homo sapiens
gatgctgtatgagtcttttctcatactactgagaaagacatacccaagactgagtaatttataaaggaaagaggtttaatggactcacaattccacatggyggtggaggtgtcaccattatggcagaaggcaaacaaggagcaaagtcacatcttacatggtggcaggcaagagaacttgtgcaggggaactcccctttat

SEQ ID NO: 32587 - DNA, 201 bp, Homo sapiens
cagtgtggtgtttcatgttagcagagtgtatcaggatcttttgttttttttttttaaattaaggatgctgtatgagtcttttctcatactactgagaaagwcatacccaagactgagtaatttataaaggaaagaggtttaatggactcacaattccacatggcggtggaggtgtcaccattatggcagaaggcaaacaag

SEQ ID NO: 32588 - DNA, 201 bp, Homo sapiens; identical to SEQ ID NO: 27101

SEQ ID NO: 32589 - DNA, 201 bp, Homo sapiens; identical to SEQ ID NO: 4892

SEQ ID NO: 32590 - DNA, 201 bp, Homo sapiens; identical to SEQ ID NO: 4871

SEQ ID NO: 32591 - DNA, 201 bp, Homo sapiens; identical to SEQ ID NO: 4870

SEQ ID NO: 32592 - DNA, 201 bp, Homo sapiens; identical to SEQ ID NO: 4879

SEQ ID NO: 32593 - DNA, 201 bp, Homo sapiens; identical to SEQ ID NO: 27106

SEQ ID NO: 32594 - DNA, 201 bp, Homo sapiens; identical to SEQ ID NO: 27107

SEQ ID NO: 32595 - DNA, 201 bp, Homo sapiens
cacataagaattttctaagcagaggttccaatttggatatttcgtggccttcaggttatttgtaaccagtacacaaaccacaaagtcataatcagatagaktttctttccagcctgtctttcctctttggttgctttgtaaatctattactcatcagatcatatgtttggcaaatgccacttttcattttgaatcaatgga

SEQ ID NO: 32596 - DNA, 201 bp, Homo sapiens
ataatttacataatttatgttctataaaattagcatattttaaatatacagttctctggattttgaaaaatgtatacgtgtacataatcatggatccaccmccccagttaagatatagaacattccagggccaggttcagtggatcatgcttgtaatcgcagcatgttgggaggctgaggagggtggaccacttgaggcca

SEQ ID NO: 32597 - DNA, 201 bp, Homo sapiens
gacataatttacataatttatgttctataaaattagcatattttaaatatacagttctctggattttgaaaaatgtatacgtgtacataatcatggatccmccaccccagttaagatatagaacattccagggccaggttcagtggatcatgcttgtaatcgcagcatgttgggaggctgaggagggtggaccacttgagg

SEQ ID NO: 32598 - DNA, 201 bp, Homo sapiens
attattattattattattattatattttgagacagggtcttgctttcttgcccaggaaggagtgcaatagtgtagtcatggctcactgcagccttgacctyctgggctcaagcaatcctcccacctcagcctcctgaatagctggagctacaggcaagtgtactgtggcaattgttaatgttcacttttatttccatagtt

SEQ ID NO: 32599 - DNA, 201 bp, Homo sapiens
tattgtgtctgtgatgtatttgagtaccaggtatccctgattaccatagagtaatgtcttttattgaggcttttattattattattattattattattatwatattttgagacagggtcttgctttcttgcccaggaaggagtgcaatagtgtagtcatggctcactgcagccttgacctcctgggctcaagcaatcctcc

SEQ ID NO: 32600 - DNA, 201 bp, Homo sapiens
gtcctgttgatggcatcccacaactttctaacctctgttgtagagttttgttagccacgatttggaccaacctgcagttaggccaagggctgctgatccarttggattaaggaactctgctgtttgagcatgttggcttcattcattggtatctcctacgccaagtcctaggcttggttacaaagggcaatgaagggtctt

SEQ ID NO: 32601 - DNA, 201 bp, Homo sapiens
ttgaataacaatatgtaatttcaggtttaggattgttgatctgtaaatctcagcctagtgctttcaactcctggctttctcctaagttcaccctcctcccytccctcctttctgtaaggactctaaacgattgcgcttcattaagttatttttataatgagttcctgttaccagggaatacagagttaaaaaggtgatctc

SEQ ID NO: 32602 - DNA, 201 bp, Homo sapiens
ttaagaagatctttgtccctcccccaccccccgccccgatttatactatggatcagcagcctaaaccctgcaaactgggtcccccatctaagagtctgcartgaaacgcgagccgacttgatgtgtctcagagtgatcattcttgcccttggcggttgatgctagactgttgcagcttcaaatataatgtattttagtgct

SEQ ID NO: 32603 - DNA, 201 bp, Homo sapiens
taagtaaaattttattaaaatacagctccactcattcatttatatattgttcatatctaattattttcacactgcaatggtgcatagtcaaatgctttctwtctggctttttaagaagatctttgtccctcccccaccccccgccccgatttatactatggatcagcagcctaaaccctgcaaactgggtcccccatctaa

SEQ ID NO: 32604 - DNA, 201 bp, Homo sapiens
caagaagatgtctctctttgaattcaactcagaggtcagcttcactgcctgccctgtggagtcgactctgtgtcccacccttcaggaatacggcttaatartaagatgataaggattcgtaccagggattggcaaatgacagtcattttctgtttccttaagtaaaattttattaaaatacagctccactcattcatttat

SEQ ID NO: 32605 - DNA, 201 bp, Homo sapiens
taatgaggacttaaatgtgtccctgctgaccgagccagaacttatttttatgttgccactaggagtcttctgagatgctcttgtggctggatgtagaatcsctttgctcatctctagacacagactagacaacgaaatacattcccctaaaatagcccagggttagttctatgacctttgtcactgttggtacagttctaa

SEQ ID NO: 32606 - DNA, 201 bp, Homo sapiens
tgtgtgtgtgtggtgtgtgtgtgtgtgtgtgtgtgtgtgtgtgtgtgtgtgtgtgtgtgtgtgtgtgtgtatacctagtctagggctaggtttgggaactrttttctcccgtaagttaaactgaactagactgtatgtcaaaaaagagtctcaatgtcaacttaatccattgtcatgactgtaaaatgctatttcattata

SEQ ID NO: 32607 - DNA, 201 bp, Homo sapiens
ttaaggaggagaaatttgagttttcatattgtcagtctcaaaccttttctgaaattggaagtgatgaagtgacagtctggctatatgtgtgtgtgtgtggkgtgtgtgtgtgtgtgtgtgtgtgtgtgtgtgtgtgtgtgtgtgtgtgtgtgtgtgtatacctagtctagggctaggtttgggaactattttctcccgtaa

SEQ ID NO: 32608 - DNA, 201 bp, Homo sapiens
tttaaggaggagaaatttgagttttcatattgtcagtctcaaaccttttctgaaattggaagtgatgaagtgacagtctggctatatgtgtgtgtgtgtgktgtgtgtgtgtgtgtgtgtgtgtgtgtgtgtgtgtgtgtgtgtgtgtgtgtgtgtgtatacctagtctagggctaggtttgggaactattttctcccgta

SEQ ID NO: 32609 - DNA, 201 bp, Homo sapiens
agatgtctagaatttcatctcacatctaaactgttttaagacacttggtacacattgatatgtattgtccaattgctttccagaaactatataaaatattmcaaagaaaaacatatatatatatatatatgtaaaatatatatatgaagggagaaataaatgtaaatgaaaagaaaaacatatagagaaagaatatgtcta

SEQ ID NO: 32610 - DNA, 201 bp, Homo sapiens
tgtatcctatgtgattatagttacaatgagttcactaaaaagcaaactattcctattagaagtcagggtagaggatggatgggagcatgaagtgtcctccrtcatgttgctaatgttctgttgcttgttcaagctactgggtgtgttcagtttatgaaaattcatttagtgacacatgtatgttttgtgaatttttttgca

SEQ ID NO: 32611 - DNA, 201 bp, Homo sapiens
ctaaattcaacaatgtggatttatcttacagagatgatgttgagagaaaggaggaagatacagaggaatgtatcctatgtgattatagttacaatgagttsactaaaaagcaaactattcctattagaagtcagggtagaggatggatgggagcatgaagtgtcctccgtcatgttgctaatgttctgttgcttgttcaag

SEQ ID NO: 32612 - DNA, 201 bp, Homo sapiens
ctgaatcattattcatgattactcaagacatctggtaaaccacccagatatctatcagtggtggaatggataaataagttgtaataaatccacacaagagsagactactcaccaacaagaatgaatgacttagaactaaattcaacaatgtggatttatcttacagagatgatgttgagagaaaggaggaagatacagagg

SEQ ID NO: 32613 - DNA, 201 bp, Homo sapiens
gcccgggagacggaggttgcagcgagccgagatcacaccactacattccagcctgggtgacagagcaagagtccatttacaaaacaaaaacaaagaactgmcaataaatagttttctccgttttgtgacttatttttaattattaagaataagtgtcataaagccaatactttctaacatgtgtatagtatgttatagttt

SEQ ID NO: 32614 - DNA, 201 bp, Homo sapiens
tcacggctcactgcaacctttgcctcctgggcgcaagtgatcctcctacctcagcctcccaagggagctgggaccacaggggcacaccaccatgcctgccyaatttttgttgttgttgtattttttggtacagatgggattttgccatgttgcccaggctggtctcaaaactcctgggctcaagcgattcacgtgcctcag

SEQ ID NO: 32615 - DNA, 201 bp, Homo sapiens
cctttgggagaagatggtttcaaagaacttactgtatcaaatggaaagacaatgtgttttcccaacatgggagtatgtttctaagttgggatcagttcacrattcagagaaatgctctgccttcttgtctatgatatcagatcaggtcagacgtaggtataagaccctgactcctgttttccaagcacttttttttttcat

SEQ ID NO: 32616 - DNA, 201 bp, Homo sapiens
tcttttgctcactattgtacttcagggcctagaggaaggcttagcacgtggaagacaatatttattggaggaatgaatctagaaatatccttggatgtatratgtccaactcactctaccacacagcaacataggtagttttatatacattttatagctaagcccagcagcccaaaaagctaaatgacttcagcgcccaca

SEQ ID NO: 32617 - DNA, 201 bp, Homo sapiens
gacttaaagacatgttggcaatgggtagtggacaaaaattgaaacaccttcaactgtgtctgtgaccagaagatttttttctttttttttttttttttttktttggctgactgtcatgacttagtaaggccatcacaggttgccagaacatctactcaactgttccaagcataacctcctacacaggccttctacatagga

SEQ ID NO: 32618 - DNA, 201 bp, Homo sapiens
tctccactacagattctgatggcaagtgacttaaagacatgttggcaatgggtagtggacaaaaattgaaacaccttcaactgtgtctgtgaccagaagawttttttctttttttttttttttttttttttggctgactgtcatgacttagtaaggccatcacaggttgccagaacatctactcaactgttccaagcataa

SEQ ID NO: 32619 - DNA, 201 bp, Homo sapiens
ctccagtggactttgattcacatcatggctctttctcttccttgctgaggcttttgacaatttcaaatgctccctgaacctcagtttcctttgccacaaartagcaatacaaatttataattccttagattgctgtgagaatgaattgaggcaaggtaggtaaagtgcaaggaattgtgtgtggccggccaggtgcagtgt

SEQ ID NO: 32620 - DNA, 201 bp, Homo sapiens
tgatttccttaaaagaagtacgtcaggtgaagggcagatagaggtcaacaccatagataaatctttacactccagtggactttgattcacatcatggctcyttctcttccttgctgaggcttttgacaatttcaaatgctccctgaacctcagtttcctttgccacaaaatagcaatacaaatttataattccttagattg

SEQ ID NO: 32621 - DNA, 201 bp, Homo sapiens
gccaccgcgcctggctttcaaattccattttttaaagttaatgctttaatatgttaaacacccttattaacatattacatatgttaatatgtaaaataaaytccgtacattttaaagtgctaaaggttgtatgtttgtgcgatggatatgtttaagagaatgatttaggatgcgatcagttttttttccttgacttactct

SEQ ID NO: 32622 - DNA, 201 bp, Homo sapiens
tcctgacctcaagtgatccacccatcttggcctcccaaagtgctgggattacaggcgtgagccaccgcgcctggctttcaaattccattttttaaagttartgctttaatatgttaaacacccttattaacatattacatatgttaatatgtaaaataaactccgtacattttaaagtgctaaaggttgtatgtttgtgcg

SEQ ID NO: 32623 - DNA, 201 bp, Homo sapiens
tttgtatttttagtagagttggggttttaccatgttggccaggctggtcttgaactcctgacctcaagtgatccacccatcttggcctcccaaagtgctgkgattacaggcgtgagccaccgcgcctggctttcaaattccattttttaaagttaatgctttaatatgttaaacacccttattaacatattacatatgtta

SEQ ID NO: 32624 - DNA, 201 bp, Homo sapiens
attcatcaggaattattttataaatttttgatgttggatatctgaagataatacagaatggagcccttttttactttacagattttttttttttttgagasagaatcttgctctgttgcccaggctggagtgcagtggtgcagtcatggttcactgcagcctcgatctcctggggctcaagccatcctcccacctcagcct

SEQ ID NO: 32625 - DNA, 201 bp, Homo sapiens
gccttagataaatagcattttcacgagtaaactttttagttctcaaaagaaaaattgtaacaattttctagccgcatattagcattatgcacaaacacatraacttttggctggaattgtggaatatgaagtagctcccatccttattccatcgcccatatgctaaaatgtagattgtattagttgagaaattttaccaaa

SEQ ID NO: 32626 - DNA, 201 bp, Homo sapiens
aatatatatatatatatatatatatatatatgaaaaaaaggacaaacgatttcagttgcacaactataatcgatgaagtggctccttgatgttctcggggyaatctgagacactggggagaaccctccacctttgcagagaagcaggatgaaggggcctaaaatgagttcaactgatttcaactttgtttcccagcataaa

SEQ ID NO: 32627 - DNA, 201 bp, Homo sapiens
cggctggccaatatctactagttttgaaattaaaaaaaaaaaaaaaaaaatatatatatatatatatatatatatatatgaaaaaaaggacaaacgatttyagttgcacaactataatcgatgaagtggctccttgatgttctcggggcaatctgagacactggggagaaccctccacctttgcagagaagcaggatgaag

SEQ ID NO: 32628 - DNA, 201 bp, Homo sapiens
acctcagcctcccaaagtgctgggattacaggtgtgagccaccacggctggccaatatctactagttttgaaattaaaaaaaaaaaaaaaaaaatatatawatatatatatatatatatatatgaaaaaaaggacaaacgatttcagttgcacaactataatcgatgaagtggctccttgatgttctcggggcaatctgag

SEQ ID NO: 32629 - DNA, 201 bp, Homo sapiens
tccatcaacatgtcctttttatttttttgagatagtgtcttacttcatcacccattctgtagtgcagggcacaatcacagctcactgcagcctcaaacttytaggcttaagtgattctcccatctcagcctcctcagttgctgggaccactggcatgtgtcaccacatctggctaattttttgaacttttttgtagttggg

SEQ ID NO: 32630 - DNA, 201 bp, Homo sapiens
tgccttttgatcaagcaattccattctgtaccagaaaatacagaaatatttgaatgaatgtgccaggacacccaattagaagaatgaatgcttttttagcrttattttgtgtgcatacatatttatttagttatttgacctattacattctaaattgatattaataaagaggtatttgagttacagtttttccaaagtttt

SEQ ID NO: 32631 - DNA, 201 bp, Homo sapiens
aataatttatctcacatatgcaaagagttttggctaagggaaaagaaaaatgtgaacctcctaatagaaaaatgggcaaagataatgaacaagaaattcaytgaaaagaattggcaaacatgaaaaaattctcaactttatttttaatcataaaaatggaaattgaacaatgagatactgtttttcaccatgacattggca

SEQ ID NO: 32632 - DNA, 201 bp, Homo sapiens
catagaaaaggtacagttaaaatatggtattacaatcttctgggatcaccattgcatatgtggttcattgttgatcaaaatgtcattatgcagtgtgtgayagtgcttaaataatttatctcacatatgcaaagagttttggctaagggaaaagaaaaatgtgaacctcctaatagaaaaatgggcaaagataatgaacaa

SEQ ID NO: 32633 - DNA, 201 bp, Homo sapiens
aataattagggaaagtttccttcagacaggggaagacaaatatgagtatccagggaggatgtttctggcagagggatcagcataggaaaggagttcagggwtgaaaagagtcagtctggtccctagaaataatttttttggtgcataaagggccagaacagaatgacagaggaaaatgataaggatttaggcagggactgc

SEQ ID NO: 32634 - DNA, 201 bp, Homo sapiens
gaaacacattctaatttggcagtgagttcaggagatgaagactgtcctttagttaacatcaatagctttctaaaatatgtagccagttaatattttacttytgcctatgcatccctcaaattgtaacacccctggaacataaaaattcctctattgagattaacacctaacgatacctgtatttgctaatttgtttctttt

SEQ ID NO: 32635 - DNA, 201 bp, Homo sapiens
tcccactagacggtgagggactttatctgtctcattcaccactttgtccaacctaggacagtgtccgacacatagagatgctcaataaatcttggctgagkcaatacgtttcaaaatacaaggtgactccaaatataaaacaattttttattttcaaatgaagtggacctcccctaaattttgtgcccagtttataaactt

SEQ ID NO: 32636 - DNA, 201 bp, Homo sapiens
gtattgcacgtttgtgtttgtttattttccatctttcccactagacggtgagggactttatctgtctcattcaccactttgtccaacctaggacagtgtcmgacacatagagatgctcaataaatcttggctgagtcaatacgtttcaaaatacaaggtgactccaaatataaaacaattttttattttcaaatgaagtgg

SEQ ID NO: 32637 - DNA, 201 bp, Homo sapiens
acagggtaatgatgaggttgaaccaccagttctcaatgccatacatgagattcccaaaatagacgggagttacacagagacctttttttttttaacctccwctgagattttttttaacctcctctgagattctgtatttccttaatgagccgaaaaatctatttagcccagtttttatccttgcagataagttagtacgct

SEQ ID NO: 32638 - DNA, 201 bp, Homo sapiens
tttgcctagggctgaccctgaagcagaaagcaaagcctagatcagtctgctctcctcctaccaacagggtaatgatgaggttgaaccaccagttctcaatsccatacatgagattcccaaaatagacgggagttacacagagacctttttttttttaacctcctctgagattttttttaacctcctctgagattctgtatt

SEQ ID NO: 32639 - DNA, 201 bp, Homo sapiens
atgttgcccagctcagtctcaaagtcctgggctcaagcgattctcccgcctcagcttccctaagtgttgggattacagacttgagccactgcatctagccmcaactgagttcattattctgagctttctttgggatgttatttaactctcagtttcttcttctataagatggaaataataacaactaaaggctaggatttg

SEQ ID NO: 32640 - DNA, 201 bp, Homo sapiens
aatgaggaagtgagcaaatcacactcatcgaggagcaaaataattcattccctctccgtggctcagcatggatgcaaataatgtatcattaagtaagtccmcaaaacaaagacagccagcataactgttgcatcaaatatttagccagagccaaaagcaatttattatgttttttaaaataagtttgatttactaaccttc

SEQ ID NO: 32641 - DNA, 201 bp, Homo sapiens
tgctaagatgcgaatgcccagctcaggggatgagattactgtcagctttgcctaagctttgggcattagcaccctccatatgcaacaaacccacaaatgamatgttttgactctttgacacagaatggttggaaatcacttccttggccagagcaggggtccggtgtaaaggaggaaataaaaataaaaaagcataaatga

SEQ ID NO: 32642 - DNA, 201 bp, Homo sapiens
tctacaagaagtaaaaaaaatcatctcacacctgtagccgcagctactcaggaggctgaggcagtagattcatttgagcccaggaggcggaggttgcagtsaaccaagatcacgccactgcacaccagccgggggtgacagagtgagaccctatctcaaataaaaataaaaatagaatacaaggggggataaagatagact

SEQ ID NO: 32643 - DNA, 201 bp, Homo sapiens
attaatgcactggacagagctggcagacgtgtgggacacccagctattctctggaagggaagggggatataagagacacactataaaggtgaatggtaatyggcatctccccttcaaggggaccaggaggatctgagctgactgggtgcctttgtggaagtgtgttttgaactgagattagagagatcagcaatgtatctc

SEQ ID NO: 32644 - DNA, 201 bp, Homo sapiens
atggcatggcatgatcccactacttagggaggctaattatgtagtgtctacagagccagtggtttattttgcattgtttatgtcagcattaagcagtattsttacacagtttgtaagtcttaaaactcagtatctactctagtagttgctccaaatgtgatgtcctcataaatcaccgagggatcttgttaaatttggatt

SEQ ID NO: 32645 - DNA, 201 bp, Homo sapiens
tagaaaattataaaaatagaaaacagatggctgggcacggtggctcactcctgtaatcccagcactttgggaggccaaggcagatgggtcacctgaggtcyggagttccagaccagcctgaccaatatagtgaaaccccatctctactaaaaatacaaaaagttagccgggcgtggtagcacacacctgtaatcccagcaa

SEQ ID NO: 32646 - DNA, 201 bp, Homo sapiens
agaagttccagaattgcagatggccctttgctgcttagggaggggggagaagaagaaggagaaaaagaagaaaaagaaaaagagcaggtggaaacttaaaraaatgtttagctgcatgtagatggcttttattataactgctaggctgaaccagaagacttgagctatgtaaaaatgtcacttgctcttatcacggttcat

SEQ ID NO: 32647 - DNA, 201 bp, Homo sapiens
agcagaagagagaaacagggagagtggaggttgttctctagaacatagaagccgcttcttcatcccacacaatggaaaccagagcccagattatattaacragaagttccagaattgcagatggccctttgctgcttagggaggggggagaagaagaaggagaaaaagaagaaaaagaaaaagagcaggtggaaacttaaa

SEQ ID NO: 32648 - DNA, 201 bp, Homo sapiens
atgggcttttgcgaagaagttttttcttttttcagagtcagaggttggcagcaaaatatgagagatggaaggtcaagtgcagcagaagagagaaacagggrgagtggaggttgttctctagaacatagaagccgcttcttcatcccacacaatggaaaccagagcccagattatattaacgagaagttccagaattgcaga

SEQ ID NO: 32649 - DNA, 201 bp, Homo sapiens
aatatatgggcttgaatccagtgtatcttgctccgaaagccttgcttttgtcattatccaacattagctgtctttattatagtggccttcttaccacctasaaaacaagtgccagcattctagtaaaatttattcaccttccgagattatttactattttagtctgtagcttttatccctttaactacaccattcaaagcg

SEQ ID NO: 32650 - DNA, 201 bp, Homo sapiens
gtacaatcagagatcactgcagcctccaactcctaggctcaagcgatcctccagcctctgcctgccaagtatctgggactacaagcatgcactcctgtgcytggttaattttgactatttttttgtagagatggggcttgcttgcttttttctccagtctggtcttgaactcctggcttcaagcagtcctctcacctcatt

SEQ ID NO: 32651 - DNA, 201 bp, Homo sapiens
aagaaagggtcttgctcttttgcccaggctgcagtgcagtggtacaatcagagatcactgcagcctccaactcctaggctcaagcgatcctccagcctctrcctgccaagtatctgggactacaagcatgcactcctgtgcttggttaattttgactatttttttgtagagatggggcttgcttgcttttttctccagtct

SEQ ID NO: 32652 - DNA, 201 bp, Homo sapiens
ctcagccttttctctcgatctttttttttttttttttcctttcttaagaaagggtcttgctcttttgcccaggctgcagtgcagtggtacaatcagagatsactgcagcctccaactcctaggctcaagcgatcctccagcctctgcctgccaagtatctgggactacaagcatgcactcctgtgcttggttaattttgac

SEQ ID NO: 32653 - DNA, 201 bp, Homo sapiens
gctattggcagtggcatggagtgtgggaaaatgcgtccctctctccttcctggattagaaaagtcatcatcctgctagtgtgaatccatgtcctgtggtgkccctctcaggagggattgtgattaaagaatggacaacccaagggaatcatgtgtcatggtggagcatacaggccagcaggtgagttggggaggcgccttt

SEQ ID NO: 32654 - DNA, 201 bp, Homo sapiens
ataagcatatttatatatatatacacataaaacatatatgtacatattatcataatgcctacctgctcttgagaaagtagtgccgtatggctgggggtttytctcactggtttctatggctctcccctcccccactttttctaagaagtggtagtacctatctgactattttcttggctgcctgaagaggcctcaaaatta

SEQ ID NO: 32655 - DNA, 201 bp, Homo sapiens
catttaggcaatatgaccgtgtacaggattctaccaccatcgtcaccatcagtgttactgttccctgccatctgcctatggggtgtctaccatctaaagtycagcactgcactgggcatttttaaattatcattagtatataattatatataataataatttaatttataactatatcatttattaaggtcctactatata

SEQ ID NO: 32656 - DNA, 201 bp, Homo sapiens
ggctaaatcaaatttagctgttcccccaactgcaaagtacataggcatcaagtgaaagggtaaatgcatgaaaacctgaatggctgatcctctaagacagkgagagcagatgttaattgctcactgtccaagtgctgggctctgtgataagagcttcacgcagatgacatcaaagcaccatgtgtgggggaagcacgatga

SEQ ID NO: 32657 - DNA, 201 bp, Homo sapiens
catcacgacagtaacaaatatcttagccaacagaacaaaaaatgttcctggtgagaacagccagggattctggaattgactgctgtagttcagaagagatktggcttcccacagggcattgtagagctttatgctgaaaaggtggccccagaggtctgtgtgccattgcccaggtcgagtctgcagtacaaactcctagga

SEQ ID NO: 32658 - DNA, 201 bp, Homo sapiens
ttattcactatcacgaggatagcgcaggaaagaccggcccacatgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcc

SEQ ID NO: 32659 - DNA, 201 bp, Homo sapiens
ggttagctcattgactctacaactctgttttcctcattcattcattcctctaatcaatatgtattgctcacttggtacatgtcagatactttcctaggtgytggggagaaacaagcaaagtacttcagggcctgtattagtttgtttttcacgctgctgataaagacacacccgagactgggaagaaaaagaggtttaatt

SEQ ID NO: 32660 - DNA, 201 bp, Homo sapiens
aggcttcgtgttgtttgtaaatttgtgaataaatctgttaaagaaatattggattcatattcaacttggaaaacagggaaaggccttttattgcatgcttwgaagtttgaatacactttcagtagctcttcgttatctcaaattaaatcttaaattgagcttgtggttctgtgaattaatactccagcctttcagccctgc

SEQ ID NO: 32661 - DNA, 201 bp, Homo sapiens
tgcatgccctccaacagtggaagtggtgccctgaatacgccagaaataatcgtggagtcaacgaagatctgggagtattgtttggagacatctcagtattsctaattcattttcccatccttaaataaaaatctttcttactgatgatctgagaacttcttgtaagccccatttccatgagtagagttggccattgcccac

SEQ ID NO: 32662 - DNA, 201 bp, Homo sapiens
ttatcattcctttgataaccgtgagcacctgtcatgggcctggcactctagtaggctctcaggatgcacaatgaccctgtccctgcttgctggagacatargagaagcccccagccactgacatctgggtgttgtaagaaagcaagaacagtcatggacactgctaagttttgatgccaaagagccaaatttgcagtacca

SEQ ID NO: 32663 - DNA, 201 bp, Homo sapiens
aaagtattgcttcttaagcctgggccaagtgtgtagacttgatagaattctgattaatgcatcttattacattaattttagaagaaaccagaaggcatttytcctattcctagtgcaggccagcctgccagaagcatttgcctccttaaagagctaatatcttcagctaccaacaatcataaaactgaaagatctatcgga

SEQ ID NO: 32664 - DNA, 201 bp, Homo sapiens
cttcaaccctgactctgattcacaaagaatagggaagcttagccaactgcagtttcaaagtattgcttcttaagcctgggccaagtgtgtagacttgataraattctgattaatgcatcttattacattaattttagaagaaaccagaaggcatttctcctattcctagtgcaggccagcctgccagaagcatttgcctcc

SEQ ID NO: 32665 - DNA, 201 bp, Homo sapiens
ttcccctaaccctctgtaatccctggtggagctaaggaatgaaaagttgcttaaacattttcctgttgccagtttttcttaaacattagtgctattctttyttttttttttttttttttttttttttccttcttcaaccctgactctgattcacaaagaatagggaagcttagccaactgcagtttcaaagtattgcttct

SEQ ID NO: 32666 - DNA, 201 bp, Homo sapiens
tcacattaaaagcacaaccaaattgtagtacaatgttcaggacacttttatgtcactttaaaatgtagagtatcatctaaaaatgagcaattgctgtgaaraaactggggttggctctgattttgtggctcagttttttttggtttcttgagaagatcatctttaagtcaaaagttatgcaatgccaagtactcatctgtg

SEQ ID NO: 32667 - DNA, 201 bp, Homo sapiens
gctgttcctgctgttactaactggagtacattgcatgaaaccttgctgtttccttaaaccctgcaccgacctttacaaacagtgcctttactaaacacttyttacgttacccgttttgagtgtaccatctgcctcttgccaggaccctgaccaagaatttgaaatctcagaccatgatgacctccttgcccaatgcgtaag

SEQ ID NO: 32668 - DNA, 201 bp, Homo sapiens
cccccaattctataggttctattatatctccgctggtttaaggcaactgctgtttcttttaggagttttcttttctttccttgctgaatatctgcacttascaatactgcccaggcacatgggctgtggctcaagttttcagtgcaggacagtgtgtcattgcaggagaagacagaacccggccagatcctcccgctgccg

SEQ ID NO: 32669 - DNA, 201 bp, Homo sapiens
ttttttttttgtattgtttgtatttttcatgtttttcgtagagtcagggtttcacagtgttatgcaggatggtctcgatctcctgacatcgtgatccgccygcctcagcctcccaaagtgctgggattacaggcgtgagctgacgctcccggcctacagcatagatttgaggcatcttgaaggtagatgcagaagagtggg

SEQ ID NO: 32670 - DNA, 201 bp, Homo sapiens
ccgccacctcgcctggctaatttttttttttgtattgtttgtatttttcatgtttttcgtagagtcagggtttcacagtgttatgcaggatggtctcgatytcctgacatcgtgatccgcccgcctcagcctcccaaagtgctgggattacaggcgtgagctgacgctcccggcctacagcatagatttgaggcatcttga

SEQ ID NO: 32671 - DNA, 201 bp, Homo sapiens
catgccattctcctgtctcagcctccggagtagctgggactacaggcacccgccacctcgcctggctaatttttttttttgtattgtttgtatttttcatrtttttcgtagagtcagggtttcacagtgttatgcaggatggtctcgatctcctgacatcgtgatccgcccgcctcagcctcccaaagtgctgggattaca

SEQ ID NO: 32672 - DNA, 201 bp, Homo sapiens
tgggtttcaaaggtactcttttttcttttttgagacagggtctcgctgtgttgcccatgctggagtgcagtggtgcgatcacagctttctgcagcattgascttgtgggctcaagcaatcctcctgcctcagcctcccaagtagcttagaaccacaggcatataccaccatacctggacatgtttttaactttaattttta

SEQ ID NO: 32673 - DNA, 201 bp, Homo sapiens
tccttaaataaaaagctgtggctatgaagaagtgagagtttttttttttttcctctccaaaccaccacgtgctcttgtgtgttattgtagtggcttcgcaragtatttatttggccagaaagtctatagtcaaattgctcttcattctcaagtgtagtatttatttctccagctcatgcagaattctgttttatatggagg

SEQ ID NO: 32674 - DNA, 201 bp, Homo sapiens
ctactaaaaatagagaagttagccaggtgtggtggtgggcgcctgtaatcccagctacatgggaggccgaagcaggagaattgcttgaacccaggagggasaggttgcagtgagacaagatgatgccattgcactccagcctgggtcacagagcaagacttcatctgaaaaaaaaaaaaaaaaaaaaaaaaaaagaaaaat

SEQ ID NO: 32675 - DNA, 201 bp, Homo sapiens
gatcagcctgggcaatatggtgaagccccgtctctactaaaaatagagaagttagccaggtgtggtggtgggcgcctgtaatcccagctacatgggaggcygaagcaggagaattgcttgaacccaggagggagaggttgcagtgagacaagatgatgccattgcactccagcctgggtcacagagcaagacttcatctga

SEQ ID NO: 32676 - DNA, 201 bp, Homo sapiens
cagctactcaggaggctgaggcaggaaggtcacttgaacccaggaggtagaggttgcagtaagctgatatcatgtcaccgcactccaacctgggtgacaargctagaccctatctcaaaaataaacaaacccttgctattttagcttccgatgaggatatttatccttctagcatttgaatgcagccaaagtccttactgg

SEQ ID NO: 32677 - DNA, 201 bp, Homo sapiens
agcctgtacttgagtccttagacagaaagcatcttatcattcacaagcttagctatgcaatatattcctccctccccccaaggtagttgttgttgggtttktttttttttttttaagagatttacagtgatctttccatataggtttttctcgaaacatatatatttttaatttctcaccatctcaggggtaaataaatat

SEQ ID NO: 32678 - DNA, 201 bp, Homo sapiens
ctttatcaatagaagtggggaaatcgtacctgccctgtctgcctcattggatgtggaagaaatgacataatccatgagagtggcttctgaatgaagagaasctgctaaagggaagacatgatctcaagtcagccacctctgacccaaataagaacacataattacaagactgtattgtataatcatgcaggacacaaggta

SEQ ID NO: 32679 - DNA, 201 bp, Homo sapiens
gttttttgtttttttaagggaggaaatttctttcagaagtcagtactggacattcccttatttcaccttgagctacacatcccatagtcagcttagccctstccctggtgcgggggagcaggactgttgcctgtatcccttagtcattgccgcaggcttgctgcatcacaaaccaccattagacctcagtggcccgcagca

SEQ ID NO: 32680 - DNA, 201 bp, Homo sapiens
tattgttttttgtttttttaagggaggaaatttctttcagaagtcagtactggacattcccttatttcaccttgagctacacatcccatagtcagcttagmcctgtccctggtgcgggggagcaggactgttgcctgtatcccttagtcattgccgcaggcttgctgcatcacaaaccaccattagacctcagtggcccgc

SEQ ID NO: 32681 - DNA, 201 bp, Homo sapiens
ataaggctgcagtaattctcttcccaccttcgatgggcaggtgcaacctttggctgcagaaattctcacttcccagcagcagctttgagcaccctgctctkaatgtttcttgggcagcagcagctagggaagaaactcagttaaggctgtttgaggacccaaggtggtctcactctgcaacacacatcggcagccagtggt

SEQ ID NO: 32682 - DNA, 201 bp, Homo sapiens
gaggtgtcccttttgcagttgttcagaaggtcccgtgggcaggagcagccagaggaacatgaaaccagctcgtaggtggtacttgtggcaacagcagttayagccaaggagaagttaaattctaaagacttgggcagtctccagggaatatactaactgagaaataacatccataaaaataattcaatactagtatgtaaa

SEQ ID NO: 32683 - DNA, 201 bp, Homo sapiens
aaggtcagctcctgaccttcataataaggactcacatgtgtcggtcccaaggatccccaagggatactcatggttgaaggtgtctatgtgttctccttggwgtccagcgaatgcctcttgacaatctgtggtcatactcacaacctatgaccacatacgaggaagcgaggtgtcccttttgcagttgttcagaaggtcccg

SEQ ID NO: 32684 - DNA, 201 bp, Homo sapiens
ccctgatgagattacaggtcctcagtctcctcattgtatctgaagactaaagaatcagaaatttgtgactccacttagtttttctccacccaggagccctyaggccgctggtgagtgaagttcttacccattagggattattaatatactagataagagtacagtctctggagctaggcttgtgactttgaacaaattatt

SEQ ID NO: 32685 - DNA, 201 bp, Homo sapiens
aaaagagacagccagtcaagccctgactccttttgtgaccctgatgagattacaggtcctcagtctcctcattgtatctgaagactaaagaatcagaaatytgtgactccacttagtttttctccacccaggagccctcaggccgctggtgagtgaagttcttacccattagggattattaatatactagataagagtaca

SEQ ID NO: 32686 - DNA, 201 bp, Homo sapiens
agggcctctgaatgagagctgggagaggccagaatgggcctgtaagaggttgatgtgtatgagacctgaagccctatgcctttgggaaggagaggaaggastaatatttgtgtggtacaaaggatgtgcctggcataccccatatcttttacaaagacataaatgtcttctgaataaaagtatgatgatgatgatcatggt

SEQ ID NO: 32687 - DNA, 201 bp, Homo sapiens
ctgttattttatgtttcactaagagtgcgaagaacattgttaattatacaatgatccaaaaatgtcttctctctcagaatgtattgttttatatctattasaaaggctcttttgacttaggcatagatttctcatacatcaggccatttctatgcctgcctgtgaacacagggattttgaattacaatactgaatcctagt

SEQ ID NO: 32688 - DNA, 201 bp, Homo sapiens
cttatttgctccatgcaatgttcacaggtctttacatgtaaaaacaaccctgtaaaataaataacattattctcttcattctccaagtaagctgaggcagmggattccagcacaagcaatttggttccaaaacctgcccttttaacctctaccagattttggtgaactctctgtctttggaagggtaggtggcggctgcgg

SEQ ID NO: 32689 - DNA, 201 bp, Homo sapiens
tgtaagtgaggccatgcagtatttgattttctcttcctgcattagtttgctgaggataatggcttctagccccgtccgtgttctcgcagaagacatgatcrcattcttttatatggctgcatagtattccatggtgtatattcactactttttttttaatccaatctgtcatttgtggacatttaggttgattccagtaga

SEQ ID NO: 32690 - DNA, 201 bp, Homo sapiens
tcatttagcttccacttgtaagtgaggccatgcagtatttgattttctcttcctgcattagtttgctgaggataatggcttctagccccgtccgtgttctygcagaagacatgatcgcattcttttatatggctgcatagtattccatggtgtatattcactactttttttttaatccaatctgtcatttgtggacattta

SEQ ID NO: 32691 - DNA, 201 bp, Homo sapiens
tgtgcaggtttgttatataggtaacttcatgtcacaaaggtttgttgaacagattatttcatcacgcaggtaataagccttgtatccaatagttatttttmtgatcctctccttcctctctccctctaccctcaggcaggccccagtgtctgttgttctttctttgtgtccttgagttttcatcatttagcttccacttgt

SEQ ID NO: 32692 - DNA, 201 bp, Homo sapiens
gacggttggcaccgatgctaatcagtgctatgggaaaataggcagagcgaggagcgtaagaattattatgtgtgctgtttgatagagactgtacaaggaaracctctctaaaaaggtgacatttggagcagagacatgaaggaagggattgctggaggcagaacattctaggcagaaggaaccgcacgtgcaaaggccctc

SEQ ID NO: 32693 - DNA, 201 bp, Homo sapiens
cccacgggccaggactgggatctggactgggccatggcccattggatggcagaaaggttctcactgaagcccccataaaggtgggactcactgggaaaccsctctctgtggtgccagggaaggacgtctgtgggaggtgcctaccaaggaagtctctggaaatcagcctgcaggggtggagtgccgggaaactcccgcccc

SEQ ID NO: 32694 - DNA, 201 bp, Homo sapiens
gagttcgagatcagtgtggacaacatagggaggtcctgtctctacaaaaaataaaaaataaaataaaaaaataaaaataaaaataaataaaaagtagttgsgcgtgtgttgtggagcatgtgggggtcccagctacttggcaggctgaagcaggaggatcgcttgagctcaagaggttgaggctgctgtgagctatgatct

SEQ ID NO: 32695 - DNA, 201 bp, Homo sapiens
tttggctactaaagggtaaagagaatcaggccgagcacagtgactcatgcctgtctgtaatcccagcactttggaaggccaaggtggaaggatcgcctgastccaggagttcgagatcagtgtggacaacatagggaggtcctgtctctacaaaaaataaaaaataaaataaaaaaataaaaataaaaataaataaaaagt

SEQ ID NO: 32696 - DNA, 201 bp, Homo sapiens
gatgagttaaaaaaaaaaaaaaaaaaaaagttgcctggcttggtgcagtggctcatgcctgtactcccagcactttgggaggctgaggtgggcggatcatytgaggtgaggagtttgagaccacactggccaacatgttgaaacccgctctctactaaaaatacaacaattagccaggtgtggtggcgcacgcctgtaatc

SEQ ID NO: 32697 - DNA, 201 bp, Homo sapiens
tcttggctttggattttgtcccttttttaggctgcggggcggggggtcggttattttataagcaaagaagtacagccagtatgattctgaagcaactaggycacagtagaaaaaagttggagagtgaaatctcaagcaagccaaaaagtgatagatgagttaaaaaaaaaaaaaaaaaaaaagttgcctggcttggtgcag

SEQ ID NO: 32698 - DNA, 201 bp, Homo sapiens
gcctgggcttcccaaagcgctgagatgactgcgccaccacacctgccacaaaatttctttgttatggctgaataatgtttctgtgtgagtgtgtgtgtgtstgtgtgtgtgtgtgtgtgtgtgtgtgtgtttgaataatactcctatgaacattgtaccaatatctattcagatctctgctttcgattcttctgcatatat

SEQ ID NO: 32699 - DNA, 201 bp, Homo sapiens
attcaggcagctgaggcaggagggctgcttgagctcaggaggtggaggctgaagtgagctgtgattgtgctgttgcactccagcctgggcgacagagggasagcttgtctccttgtctctaaaaaagaaaaacatgctcagaggccttgtgagttagctctctccaaagtttttaagacaaggaattcagttaatcaagtt

SEQ ID NO: 32700 - DNA, 201 bp, Homo sapiens
cctgaggtcaggagttcgagaccagcctggccaacatggtgaaaccccatctctactaaaagtacaaaaattagccaggtgtgatagcgggcgcctgtaaycctggctactcgggaggctgaggtgggagaattgcttgaacccgggaggcagacgttgcagtgagccgagattgtgccactgcactgcagcttgggaaac

SEQ ID NO: 32701 - DNA, 201 bp, Homo sapiens
agtgagtatggccttttggtcagcattgcagaacctggcaagtcctaattccctgtgagcttgacacaggaggccgcctcctcctccaggcttacttggargcattctgtcctcttgttggaagggaaattggtatggtagggaggtgcttcttctgggagtgggtttgtaaaatcaagactgttttcatccaaaccagtt

SEQ ID NO: 32702 - DNA, 201 bp, Homo sapiens
cccagtccagtgagtatggccttttggtcagcattgcagaacctggcaagtcctaattccctgtgagcttgacacaggaggccgcctcctcctccaggctyacttggaagcattctgtcctcttgttggaagggaaattggtatggtagggaggtgcttcttctgggagtgggtttgtaaaatcaagactgttttcatcca

SEQ ID NO: 32703 - DNA, 201 bp, Homo sapiens
acccagtccagtgagtatggccttttggtcagcattgcagaacctggcaagtcctaattccctgtgagcttgacacaggaggccgcctcctcctccaggcytacttggaagcattctgtcctcttgttggaagggaaattggtatggtagggaggtgcttcttctgggagtgggtttgtaaaatcaagactgttttcatcc

SEQ ID NO: 32704 - DNA, 201 bp, Homo sapiens
aacggctccgccttcctgccagaatttctccgtggggaggagctgccacccagtccagtgagtatggccttttggtcagcattgcagaacctggcaagtcstaattccctgtgagcttgacacaggaggccgcctcctcctccaggcttacttggaagcattctgtcctcttgttggaagggaaattggtatggtagggag

SEQ ID NO: 32705 - DNA, 201 bp, Homo sapiens
ggatcagctggtgctccaggataaaaatcgtgtcaccacttttgccgaaaagtcactgtgtttctcctgtactcagcaggttacagggtgccatattgttytcagtcttccggctctaccctgttttgaagtgcggccgggtgttgttaaacggctccgccttcctgccagaatttctccgtggggaggagctgccaccca

SEQ ID NO: 32706 - DNA, 201 bp, Homo sapiens
tcctggtggggggaccagatgagcaatagatctccatatgcagaggggtaactgagtacgactctgggacttacactagaacattcatattgcaataaagsagatttttcctgagcacctactctgtgccaaagcactattgtaggctgtggagatagggagctgaagtactgaaagcgttacagtcaagggccagaaaac

SEQ ID NO: 32707 - DNA, 201 bp, Homo sapiens
tattgaaggctgagaacagaacgacaaacaacaatcacaacaaaaggctggggaagattttcctggtggggggaccagatgagcaatagatctccatatgyagaggggtaactgagtacgactctgggacttacactagaacattcatattgcaataaagcagatttttcctgagcacctactctgtgccaaagcactatt

SEQ ID NO: 32708 - DNA, 201 bp, Homo sapiens
ttggtaagtgttattattgaaggctgagaacagaacgacaaacaacaatcacaacaaaaggctggggaagattttcctggtggggggaccagatgagcaayagatctccatatgcagaggggtaactgagtacgactctgggacttacactagaacattcatattgcaataaagcagatttttcctgagcacctactctgt

SEQ ID NO: 32709 - DNA, 201 bp, Homo sapiens
gtatctgtaatatggggaatcataaaagcacctacttgttaaggcatattaaatgcaacgctactttgaaggactcatagtagttaacacccagtttggtragtgttattattgaaggctgagaacagaacgacaaacaacaatcacaacaaaaggctggggaagattttcctggtggggggaccagatgagcaatagatc

SEQ ID NO: 32710 - DNA, 201 bp, Homo sapiens
acacttaatacctccttggctttgaagctctcctttgtggcactacaaggtcctctttgaaatcccacattcttttttggatttaggtattaaccccttgstgtgaggagaaagataattgtcaacacacttaggagagaaatcatgcagtaaagctgacccgacatagactaacttaaaactaactagttcattagtgct

SEQ ID NO: 32711 - DNA, 201 bp, Homo sapiens
ccttaacttaatcacacttgcatttgattttatcatgcaaggtagcatactcacaggtgggattaggacttagacaccttcagcaagaaacattactcagsccaacacactcctcaaacctaagcttattcccaatcacacagtcaggagaggatgcccacaatgcacttggggttttgtgtctgtgtctcccctccaaga

SEQ ID NO: 32712 - DNA, 201 bp, Homo sapiens
ctgggaagtcaaggctgcagtgagcaaagatcacaccactgcagtcaagcctgggtgacagggcaagaccctatatcaaaaaaaaaaaaaaaaaaaaaaawatatatatatatatatatatatatatatatatatatgtatatgtatatataaatttaaggaagcatagaattgaagaggctattccaaggtcacatgact

SEQ ID NO: 32713 - DNA, 201 bp, Homo sapiens
acattggtaaaactttgtctttgttttaaataatcagtcagttgtctcaatccataaaagagtatctcttgtacaatgtctgcttttgagtgattcacttsgatgcgtactgaaaatatacctttaagtagttgagtgacttgaaatattggtaaatgttctttaatattttgtctgtcagtgttagagactatcaggtta

SEQ ID NO: 32714 - DNA, 201 bp, Homo sapiens
ttctggtgcctccacgtggaagtgggctgccacaatacttctaaagagaattggcatttttctttaaataagaaggaggaggatgaggagagagacgacasaaaattcactcacagaagtgaacataaattctaacattggtaaaactttgtctttgttttaaataatcagtcagttgtctcaatccataaaagagtatct

SEQ ID NO: 32715 - DNA, 201 bp, Homo sapiens
tcctattcagaggctcagtttctctgcaggacagaaatgagaggcacaaaatttcatagctgtcttgcccctcctgtggtctgtaagaatgggaccaggaytcctagttgtgaacccgaaaggatttccattaggatcaggaagtgtgagttggcttagaaaaagtaaagaaagaacagtgctgtttcatttatttatcat

SEQ ID NO: 32716 - DNA, 201 bp, Homo sapiens
gggtgatctccactgaactcctattcagaggctcagtttctctgcaggacagaaatgagaggcacaaaatttcatagctgtcttgcccctcctgtggtctrtaagaatgggaccaggactcctagttgtgaacccgaaaggatttccattaggatcaggaagtgtgagttggcttagaaaaagtaaagaaagaacagtgct

SEQ ID NO: 32717 - DNA, 201 bp, Homo sapiens
aaagagagaaagagagagacccaaaatagtcaaactgaggttttgggttctggtgatagaatattaaatcataatgaagcatttaatgttttgttgttgtkacaattgttgttttaccctagggctatgcaaagtagtttaaggatgtatttatttcagtggggaaaaaaagtggaggatatacatttggaggataaggaa

SEQ ID NO: 32718 - DNA, 201 bp, Homo sapiens
tctgccttcaaaagcctgaatttccaaggctttctgccatgagtacttagctttgaaaaacatgagcatatttttcattcttcttgccggcctctccctgygtcatgcctgttattcttttctccctcaacattgacctaggtcagaaggaccctattttaatgtttagcgtttgggggtcactccatagagaggggtttg

SEQ ID NO: 32719 - DNA, 201 bp, Homo sapiens
ggcatcttccccgccttcctccacctctgccttcaaaagcctgaatttccaaggctttctgccatgagtacttagctttgaaaaacatgagcatatttttsattcttcttgccggcctctccctgtgtcatgcctgttattcttttctccctcaacattgacctaggtcagaaggaccctattttaatgtttagcgtttgg

SEQ ID NO: 32720 - DNA, 201 bp, Homo sapiens
attacatttgaatctttcagcaagcttttggctgagctgggcatcttccccgccttcctccacctctgccttcaaaagcctgaatttccaaggctttctgmcatgagtacttagctttgaaaaacatgagcatatttttcattcttcttgccggcctctccctgtgtcatgcctgttattcttttctccctcaacattgac

SEQ ID NO: 32721 - DNA, 201 bp, Homo sapiens
gattacatttgaatctttcagcaagcttttggctgagctgggcatcttccccgccttcctccacctctgccttcaaaagcctgaatttccaaggctttctsccatgagtacttagctttgaaaaacatgagcatatttttcattcttcttgccggcctctccctgtgtcatgcctgttattcttttctccctcaacattga

SEQ ID NO: 32722 - DNA, 201 bp, Homo sapiens
tggactgattgattacatttgaatctttcagcaagcttttggctgagctgggcatcttccccgccttcctccacctctgccttcaaaagcctgaatttccmaggctttctgccatgagtacttagctttgaaaaacatgagcatatttttcattcttcttgccggcctctccctgtgtcatgcctgttattcttttctccc

SEQ ID NO: 32723 - DNA, 201 bp, Homo sapiens
gttggtggactgattgattacatttgaatctttcagcaagcttttggctgagctgggcatcttccccgccttcctccacctctgccttcaaaagcctgaayttccaaggctttctgccatgagtacttagctttgaaaaacatgagcatatttttcattcttcttgccggcctctccctgtgtcatgcctgttattctttt

SEQ ID NO: 32724 - DNA, 201 bp, Homo sapiens
acgcagactcatgtgacccatcagggcttcagggtgtcctctggtgaagggcagcagcaggacagagccccacttctagctctggctcaggttaagtgttkcagcgccctggcttctgtgtcttcatgtgcaaatggagataatagtcagcacctatgcaggttactgtgaaaacaggttggaagtatttatctacagcgt

SEQ ID NO: 32725 - DNA, 201 bp, Homo sapiens
acaatggataattttttagcaaaaggatgttccacatttaactggacattatctctgtctctctccctccttacctgcctcctatcctctcttcccacccsctacgatgtctatgtatagtttcaacctggcaaccctgtgacctcagcactaggatatggatagaaaacatagtagcccctatttacctttatcttttat

SEQ ID NO: 32726 - DNA, 201 bp, Homo sapiens
aggagacgggtcggggagactgtgcccatttgacaggtgtgaatgcgaacagaggctgcagctggttagaccagggctgtgcaaccctagagccattgccytgaccacaaagccacagtctcctagtcctaatattaagaggtaggaggtagatagagattgtcccttaagccacattccattcttcatatttttgtaccc

SEQ ID NO: 32727 - DNA, 201 bp, Homo sapiens
tttatttattcatttatttgagatggagtctcactctgtcacccaggctggagtgcagtggtatgatctcggctcactacagcttccacctcccatgttcmagctattttcctgcctcagccttctgagtagctggaattacaagcgcccgccaccatacttcgctaatttttgtatgtatatgtgtatatatatgtatat

SEQ ID NO: 32728 - DNA, 201 bp, Homo sapiens
atgcctggctcaagtactagttctatgtcaatgatggtaccaatggactctaactttagaatgttgttgactgaaggcccctgccccctgccttgctttargtggaggatctggtcaaggctttgtgaatcaggggatgctccacacctttctgctctctgcaacagggccagggatctgagtcccttcttgtctatccag

SEQ ID NO: 32729 - DNA, 201 bp, Homo sapiens
taaattctagttagagacttaggatttccagtgactgaaattggaatgttaggtgttaaagacacacatcaaaatgagactcttggttttttttataagtrcaaggattgcaagatacctgaaaagggagtatttttcccccacatgcatctcaggagggtagcctcagatataagcttaggagtcctgaatttatcatca

SEQ ID NO: 32730 - DNA, 201 bp, Homo sapiens
aatagatggcatgaagcacttcagctttgcattcaagtactcatgtgtatgatcaagcatcgtcatgatcattattgactggaaagcctgtaagaagaagsggataaggccagggtgcagactgggcagtagttccctgtcatgaatccactctgcagttgttttataacatgcaacaaaaactaaagtctaatagcactc

SEQ ID NO: 32731 - DNA, 201 bp, Homo sapiens
gccaccatgcccggcaatttttttttttttttttttttaagtagagacagggtcttgctgtgttgcccgggatggtcttgaactcctgggctcaagcgatmctccctccttatcctcccaaagtgctgggattacaggtataaaccaccaacccagcctcaggagaaataaatcttttaggaaaaaaaagtgacacagttt

SEQ ID NO: 32732 - DNA, 201 bp, Homo sapiens
atggcaccatctgagctcactgcagcctcaaccgcctggtctcaaatgatccacccaccctagcctcctaagtagctgggaccacaggtgcatgccaccaygcccggcaatttttttttttttttttttttaagtagagacagggtcttgctgtgttgcccgggatggtcttgaactcctgggctcaagcgatcctccctc

SEQ ID NO: 32733 - DNA, 201 bp, Homo sapiens
ttgtttgttttttgagacagagtcttgctcaggctggagtgcgatggcaccatctgagctcactgcagcctcaaccgcctggtctcaaatgatccacccamcctagcctcctaagtagctgggaccacaggtgcatgccaccatgcccggcaatttttttttttttttttttttaagtagagacagggtcttgctgtgttg

SEQ ID NO: 32734 - DNA, 201 bp, Homo sapiens
tgctataaacgcttaaggattccttagctttagggaatgaaactacttgggcaagaatataaaattttgttctattttattttaaagctctggttacatayggtcaagttgcttcccaaaaagcgtctctgtcaggatgatcttatgaacgacgttagtacctcaattttactgtcccatccttttttcctccttccttgc

SEQ ID NO: 32735 - DNA, 201 bp, Homo sapiens
gttacagcagacatagcaaactaatgcaaatgggctttgcttgaagtccctcagctgctaagggtcagaaacaggatttgaacctacagttttgaggcctsaacctgctatgcagtgctttcttcctgatagtgaaaccactgtggtcccaaacccacagggctctatttagatttaaacaagactatgaatgtaaacaga

SEQ ID NO: 32736 - DNA, 201 bp, Homo sapiens
aagaggaggagtccatgcaaagataaaggcagagggtgaagttgtgcatccacaagctcagatatgcctggagccatcaggtgctggaagagatactggargatctcttccagggcctctggaggaagcacagtcctgctaactcttaatttgggacttctggcttccggaactgcaaaagaacaagtttctgttgtgtgt

SEQ ID NO: 32737 - DNA, 201 bp, Homo sapiens
aagatatccctaaagacatcctgctggtttcagtggctcatgcctgcaatcccagcactttgggaggctgaggcaggcggatcacttgagctcaggaattsgagaccagcctggccaacatggtgaaaccttatccgtaaaaaaaataaaaaattagccagacatcgtggtgcatgcctgttgtcccagctatttgggagg

SEQ ID NO: 32738 - DNA, 201 bp, Homo sapiens
gataacatttctataaaatataaccatattttcaaacaaagagaaaagtggcgttgtgctacatttcttctccagtgcttggttccctagaagacagccarattctcacttcttttcctgcattcagtctcttgtgatatcacatggcatgtggcctctgaaaaactccgctgtctagttgtaaaagaatacaagtaagta

SEQ ID NO: 32739 - DNA, 201 bp, Homo sapiens
ttgtagagatggggtcccactgtgttgcccaagctggtctcaaactgaactcctgagctcaagcgattctcccgccttggcctcccaaagtgctaggatgrtgataggcaggagccaccacacctggccatggataacatttctataaaatataaccatattttcaaacaaagagaaaagtggcgttgtgctacatttctt

SEQ ID NO: 32740 - DNA, 201 bp, Homo sapiens
gacacatgccactacacctagttgatttttgtattttttgtagagatggggtcccactgtgttgcccaagctggtctcaaactgaactcctgagctcaagygattctcccgccttggcctcccaaagtgctaggatgatgataggcaggagccaccacacctggccatggataacatttctataaaatataaccatatttt

SEQ ID NO: 32741 - DNA, 201 bp, Homo sapiens
aagtgattctcctgcctcagcctcctgagtagctgtgactacggacacatgccactacacctagttgatttttgtattttttgtagagatggggtcccackgtgttgcccaagctggtctcaaactgaactcctgagctcaagcgattctcccgccttggcctcccaaagtgctaggatgatgataggcaggagccaccac

SEQ ID NO: 32742 - DNA, 201 bp, Homo sapiens; identical to SEQ ID NO: 8698

SEQ ID NO: 32743 - DNA, 201 bp, Homo sapiens; identical to SEQ ID NO: 8699

SEQ ID NO: 32744 - DNA, 201 bp, Homo sapiens; identical to SEQ ID NO: 8700

SEQ ID NO: 32745 - DNA, 201 bp, Homo sapiens; identical to SEQ ID NO: 8701

SEQ ID NO: 32746 - DNA, 201 bp, Homo sapiens; identical to SEQ ID NO: 8702

SEQ ID NO: 32747 - DNA, 201 bp, Homo sapiens; identical to SEQ ID NO: 8703

SEQ ID NO: 32748 - DNA, 201 bp, Homo sapiens; identical to SEQ ID NO: 8704

SEQ ID NO: 32749 - DNA, 201 bp, Homo sapiens; identical to SEQ ID NO: 8705

SEQ ID NO: 32750 - DNA, 201 bp, Homo sapiens; identical to SEQ ID NO: 8706

SEQ ID NO: 32751 - DNA, 201 bp, Homo sapiens; identical to SEQ ID NO: 8707

SEQ ID NO: 32752 - DNA, 201 bp, Homo sapiens; identical to SEQ ID NO: 8708

SEQ ID NO: 32753 - DNA, 201 bp, Homo sapiens; identical to SEQ ID NO: 8709

SEQ ID NO: 32754 - DNA, 201 bp, Homo sapiens; identical to SEQ ID NO: 8710

SEQ ID NO: 32755 - DNA, 201 bp, Homo sapiens; identical to SEQ ID NO: 8711

SEQ ID NO: 32756 - DNA, 201 bp, Homo sapiens; identical to SEQ ID NO: 8712

SEQ ID NO: 32757 - DNA, 201 bp, Homo sapiens; identical to SEQ ID NO: 8713

SEQ ID NO: 32758 - DNA, 201 bp, Homo sapiens; identical to SEQ ID NO: 8714

SEQ ID NO: 32759 - DNA, 201 bp, Homo sapiens; identical to SEQ ID NO: 8715

SEQ ID NO: 32760 - DNA, 201 bp, Homo sapiens; identical to SEQ ID NO: 14874

SEQ ID NO: 32761 - DNA, 201 bp, Homo sapiens; identical to SEQ ID NO: 14875

SEQ ID NO: 32762 - DNA, 201 bp, Homo sapiens; identical to SEQ ID NO: 14876

SEQ ID NO: 32763 - DNA, 201 bp, Homo sapiens; identical to SEQ ID NO: 14877

SEQ ID NO: 32764 - DNA, 201 bp, Homo sapiens; identical to SEQ ID NO: 14878

SEQ ID NO: 32765 - DNA, 201 bp, Homo sapiens; identical to SEQ ID NO: 14879

SEQ ID NO: 32766 - DNA, 201 bp, Homo sapiens; identical to SEQ ID NO: 14880

SEQ ID NO: 32767 - DNA, 201 bp, Homo sapiens; identical to SEQ ID NO: 14881

SEQ ID NO: 32768 - DNA, 201 bp, Homo sapiens; identical to SEQ ID NO: 14882

SEQ ID NO: 32769 - DNA, 201 bp, Homo sapiens; identical to SEQ ID NO: 14883

SEQ ID NO: 32770 - DNA, 201 bp, Homo sapiens; identical to SEQ ID NO: 14884

SEQ ID NO: 32771 - DNA, 201 bp, Homo sapiens; identical to SEQ ID NO: 14885

SEQ ID NO: 32772 - DNA, 201 bp, Homo sapiens; identical to SEQ ID NO: 14886

SEQ ID NO: 32773 - DNA, 201 bp, Homo sapiens; identical to SEQ ID NO: 14887

SEQ ID NO: 32774 - DNA, 201 bp, Homo sapiens; identical to SEQ ID NO: 8716

SEQ ID NO: 32775 - DNA, 201 bp, Homo sapiens; identical to SEQ ID NO: 14888

SEQ ID NO: 32776 - DNA, 201 bp, Homo sapiens; identical to SEQ ID NO: 14889

SEQ ID NO: 32777 - DNA, 201 bp, Homo sapiens; identical to SEQ ID NO: 14890

SEQ ID NO: 32778 - DNA, 201 bp, Homo sapiens; identical to SEQ ID NO: 14891

SEQ ID NO: 32779 - DNA, 201 bp, Homo sapiens; identical to SEQ ID NO: 14892

SEQ ID NO: 32780 - DNA, 201 bp, Homo sapiens; identical to SEQ ID NO: 14893

SEQ ID NO: 32781 - DNA, 201 bp, Homo sapiens; identical to SEQ ID NO: 14894

SEQ ID NO: 32782 - DNA, 201 bp, Homo sapiens; identical to SEQ ID NO: 14895

SEQ ID NO: 32783 - DNA, 201 bp, Homo sapiens; identical to SEQ ID NO: 14896

SEQ ID NO: 32784 - DNA, 201 bp, Homo sapiens; identical to SEQ ID NO: 8717

SEQ ID NO: 32785 - DNA, 201 bp, Homo sapiens; identical to SEQ ID NO: 14897

SEQ ID NO: 32786 - DNA, 201 bp, Homo sapiens; identical to SEQ ID NO: 8718

SEQ ID NO: 32787 - DNA, 201 bp, Homo sapiens
agtggaaattgtaatatttaagtattaatacctctgtttaaggttcattttgaacgccttggtgaccctatgtttttttctttgttttttgttttgttttktttttttttgttttttttttttgtttttttgagatgaagtcttcctctgttgcccaggctggagtgcagtggcgcattcttggctcactgcaaccttcgc

SEQ ID NO: 32788 - DNA, 201 bp, Homo sapiens
tggcgtgatctcagctcactgcaacctccgcctcccgggttgaagtgattctcctgcctcagcctcctgaatagctgggattacaggcgtgagccactatrtccggctaatttttgtatttttcgtagagacagggattcaccatgttggccaagctggtcttgaactcctgaactcaagtgatccgcccaccttggcctc

SEQ ID NO: 32789 - DNA, 201 bp, Homo sapiens
gtcacatgaggccatcagttgaatttcatgcctgcatgtaggtttagattttaattacttttttatggtgtcagcataacaaatgagagtcatacaaactrttgtttaatgacaaagtgggtcaaacccataattaaaaaaattaataatagatttttgttctacttgaggttttgtagcattacgtaaagcttgaaaact

SEQ ID NO: 32790 - DNA, 201 bp, Homo sapiens
tgtataggtgaaagcatagaatacatagggtttggtactatccagttttcaggcatcactgtgggtcttggaacgcatctcccgaggataagggggggctrctgtcagtgtgaacctgattagatctcaactgaaacttttttgtcacatgaggccatcagttgaatttcatgcctgcatgtaggtttagattttaattac

SEQ ID NO: 32791 - DNA, 201 bp, Homo sapiens
gcatctgaaaatactaattttgagagagagagagtgtgagagaccacatttacataacttttatacagtacattgttatagttctattttattattattgktgatctcttactgtgcctaatttataaattaaaatttatcctaggtatgtatgtataggtgaaagcatagaatacatagggtttggtactatccagtttt

SEQ ID NO: 32792 - DNA, 201 bp, Homo sapiens
tcacgcctgtaatcccagcactttgagaggccgaggcgggtggatcatgaggtcaggagatcgagaccatcctggctaacaaggtgaaaccccgtctctastaaaaatacaaaaaattagccaggcgcagtggcgggcgcctgtagtcccagctactcgggaggctgaggcaggagaatggcgtgaacccgggaagtggag

SEQ ID NO: 32793 - DNA, 201 bp, Homo sapiens
cattaaatttttttttttttttaatgtttgagatggggtctcactgtgttgctcaggtgttggtctcaaactcctgggttcaagtgatcctcccaccttakcctcccaaagtactgagattactggtgtgagccactgtgcccagatgctattagcaagtatgaacaaattagatattttcagtctactcttctgtggtaa

SEQ ID NO: 32794 - DNA, 201 bp, Homo sapiens; identical to SEQ ID NO: 8719

SEQ ID NO: 32795 - DNA, 201 bp, Homo sapiens; identical to SEQ ID NO: 8720

SEQ ID NO: 32796 - DNA, 201 bp, Homo sapiens
agagtgcagtggcacaatcatggctcactgcagctttgatctcttaggctcacgtgatcatcctcctacctcagcctcccaagtagctgcgactacaggcrtgtgctatcacacttgaaattttgtttagtgtttgtagagatgaggtctaactatgttgcccaggctggtcttgaactcctgggctcaagtggtcctctt

SEQ ID NO: 32797 - DNA, 201 bp, Homo sapiens
gctccaccagcttcttgtggaaggctgggtattatccaggcctgcccacagtcatccggaggcctaaacccctccctgtggtgctgtgtttcaatggtcaygtacgttgtccgctttcatgctcctcccgtactcctggttcctctttgaagtacgtagtagatagtggtagaagaaatggtgaaagttttaaagtctttg

SEQ ID NO: 32798 - DNA, 201 bp, Homo sapiens; identical to SEQ ID NO: 8721

SEQ ID NO: 32799 - DNA, 201 bp, Homo sapiens
atttaatacaattgattactttttagaagagttaatttttacttattactgtggattttttgttttttaacagtcacaccgaggagaagactcagtgggawcatccaaaaactggaaaaagaaaacgagtggcaggaggtttgtatgttgttgtctaaggatcttggatggaagcattaagtagatgaggaaatgtcactg

SEQ ID NO: 32800 - DNA, 201 bp, Homo sapiens
ttgcctaggctggtctcgatctcctgggctctagcgatcctcccgcctcggcctcccaaagtgctgggattacaggcgtgagccaccgtaccccgccactycatggattcttgagggcagagttttttggagccaggcttcaagcacatttgatgtgtgcctatgagataaagactgcttttaatggcaggcaaggaaaat

SEQ ID NO: 32801 - DNA, 201 bp, Homo sapiens
cccccgtgcattagctatttattgtatacaccagctgagatgccagggcttggctggctctcagctggagggctcactctctggaccttgtgtccgtcccygctggccctcagttctctggatcagggttgaaaggctgaaattctttgggtgttagcttaggatgcctctgatccatcctaacccgacattcccttgatc

SEQ ID NO: 32802 - DNA, 201 bp, Homo sapiens
aggtgattctaatctatgcaaggatgtgaaccactgctgcctttggtggcaaggtagaggaaaaacaaccaagttctgatgagttcattcaagacacacayaggtattatgtgacaggcctttggctggcactggttataccgaggcaaataagagccagttgtcatccttaggacccaatcttattagggcacagtgaca

SEQ ID NO: 32803 - DNA, 201 bp, Homo sapiens
ctaccgctcccggcctttttttttttttttttttttttttttttttaaagacagggtctcgctccgtcgcccaaactggagtgccgtggtgcgatctcggytcactgcaacctctgcatgccgagttcaagcgattctcgtgtctcagcctcccgaatagctgggattacaggcgcccgccaccaggcctggctaatttcg

SEQ ID NO: 32804 - DNA, 201 bp, Homo sapiens
gatctcggctcactgcaacctccgcctcccgggttcacgccattctcctgcctcagcctcccgagtagctgggactacaggcgcccgccaccacgcccggmtaagtttttgtgtttttagtagagacggggtttcaccgtgttagccaggatggtctcgatctcctgacctcgtgatcctcccgcctcggcctctcaaagt

SEQ ID NO: 32805 - DNA, 201 bp, Homo sapiens
cccacttccagagggtttttcttttttttttttcttttgagacggagtcttgctctgtcgcccaggctggagtgcagcggcgcgatctcggctcactgcarcctccgcctcccgggttcacgccattctcctgcctcagcctcccgagtagctgggactacaggcgcccgccaccacgcccggctaagtttttgtgttttt

SEQ ID NO: 32806 - DNA, 201 bp, Homo sapiens; identical to SEQ ID NO: 8722

SEQ ID NO: 32807 - DNA, 201 bp, Homo sapiens; identical to SEQ ID NO: 8723

SEQ ID NO: 32808 - DNA, 201 bp, Homo sapiens; identical to SEQ ID NO: 8724

SEQ ID NO: 32809 - DNA, 201 bp, Homo sapiens; identical to SEQ ID NO: 8725

SEQ ID NO: 32810 - DNA, 201 bp, Homo sapiens; identical to SEQ ID NO: 8726

SEQ ID NO: 32811 - DNA, 201 bp, Homo sapiens; identical to SEQ ID NO: 8727

SEQ ID NO: 32812 - DNA, 201 bp, Homo sapiens; identical to SEQ ID NO: 8728

SEQ ID NO: 32813 - DNA, 201 bp, Homo sapiens; identical to SEQ ID NO: 8729

SEQ ID NO: 32814 - DNA, 201 bp, Homo sapiens; identical to SEQ ID NO: 8730

SEQ ID NO: 32815 - DNA, 201 bp, Homo sapiens; identical to SEQ ID NO: 8731

SEQ ID NO: 32816 - DNA, 201 bp, Homo sapiens; identical to SEQ ID NO: 8732

SEQ ID NO: 32817 - DNA, 201 bp, Homo sapiens; identical to SEQ ID NO: 8733

SEQ ID NO: 32818 - DNA, 201 bp, Homo sapiens; identical to SEQ ID NO: 8734

SEQ ID NO: 32819 - DNA, 201 bp, Homo sapiens; identical to SEQ ID NO: 8735

SEQ ID NO: 32820 - DNA, 201 bp, Homo sapiens; identical to SEQ ID NO: 8736

SEQ ID NO: 32821 - DNA, 201 bp, Homo sapiens; identical to SEQ ID NO: 8737

SEQ ID NO: 32822 - DNA, 201 bp, Homo sapiens; identical to SEQ ID NO: 8738

SEQ ID NO: 32823 - DNA, 201 bp, Homo sapiens; identical to SEQ ID NO: 8739

SEQ ID NO: 32824 - DNA, 201 bp, Homo sapiens; identical to SEQ ID NO: 8740

SEQ ID NO: 32825 - DNA, 201 bp, Homo sapiens; identical to SEQ ID NO: 8741

SEQ ID NO: 32826 - DNA, 201 bp, Homo sapiens; identical to SEQ ID NO: 8742

SEQ ID NO: 32827 - DNA, 201 bp, Homo sapiens; identical to SEQ ID NO: 8743

SEQ ID NO: 32828 - DNA, 201 bp, Homo sapiens; identical to SEQ ID NO: 8744

SEQ ID NO: 32829 - DNA, 201 bp, Homo sapiens; identical to SEQ ID NO: 8745

SEQ ID NO: 32830 - DNA, 201 bp, Homo sapiens
gggtgggtgttacttctcaagaaggcgatggtagaaccgctggagacttcttatggctgtggcaggggactcacacgtcacaaggagtccagaggcatggstttgaagagctcttttcattcattcttccttttgttcacttgtacatcaaatacatgctgtgggcctactgtgtgctgagcactgatcttgtcaggttct

SEQ ID NO: 32831 - DNA, 201 bp, Homo sapiens; identical to SEQ ID NO: 8746

SEQ ID NO: 32832 - DNA, 201 bp, Homo sapiens; identical to SEQ ID NO: 8747

SEQ ID NO: 32833 - DNA, 201 bp, Homo sapiens; identical to SEQ ID NO: 8748

SEQ ID NO: 32834 - DNA, 201 bp, Homo sapiens
ggtatttgccaccacgcccagctaatttttgtatttttagtagagacagggtttcgccatgttggccaggctggtctcggactcctgacctcaggtcatcygcccgccttggcttcccaaaatgctggtattacaggcatgagcctctccatctggcctcagcagtgctcttctggctagcttgatcatatgccaatgttt

SEQ ID NO: 32835 - DNA, 201 bp, Homo sapiens
aagatacaatagatgtagcatctgctatatccggtaacaggataacagtgcattgctgggatgatgaggctgcagtgggctgtgattgtgccactgcattktcagcctgggtgacagaggaagaccctattacaaaaaaaaaaaaaaaaagggtctgttatcaaccatgcttttttattttattttattttattttcctgt

SEQ ID NO: 32836 - DNA, 201 bp, Homo sapiens; identical to SEQ ID NO: 8749

SEQ ID NO: 32837 - DNA, 201 bp, Homo sapiens
tgtatacataattttcatatccctgatagatattgccaaatatttaccagaagtgaatcaagtagtttttctaccaacattatctaagagggcttgtcttwttacatctttgtcagcactaagtattatctcccttacttttttttttttttggtaatctttgttactttgttaggattaaagtagcttctcattttaatt

SEQ ID NO: 32838 - DNA, 201 bp, Homo sapiens
tgctgtttcctcatttttaaatagtgggctttgatgactattcttctacataaattattacatatctgtatcatagaatcttaaaaattatttgattcaartgtatacataattttcatatccctgatagatattgccaaatatttaccagaagtgaatcaagtagtttttctaccaacattatctaagagggcttgtctt

SEQ ID NO: 32839 - DNA, 201 bp, Homo sapiens; identical to SEQ ID NO: 8750

SEQ ID NO: 32840 - DNA, 201 bp, Homo sapiens; identical to SEQ ID NO: 8751

SEQ ID NO: 32841 - DNA, 201 bp, Homo sapiens; identical to SEQ ID NO: 8752

SEQ ID NO: 32842 - DNA, 201 bp, Homo sapiens
ggaatgtgggggtcatggaagactttgtggaagagttgcaagtagaattattactgttgaaaagagatggggagttaggtagacaaacagaaaaaatgccmccaaacaataagttaggatagaaaaactccacgtatccatatgtcagttggcccatctgttcgttcatacatcctttcattcttctatccatccaaccgt

SEQ ID NO: 32843 - DNA, 201 bp, Homo sapiens; identical to SEQ ID NO: 8753

SEQ ID NO: 32844 - DNA, 201 bp, Homo sapiens
ttcctttcccaaacttttactagcttcttccatcctggacttgcaatctggctgaaaacctgctaaataagggaacaattttgacatggctcctgtactcyccacaaacctagttgattccagaccagtaatgtcttggggacagtgttgtcccatcttcctttctaggctgggctcagattactgacgtggaagagttgt

SEQ ID NO: 32845 - DNA, 201 bp, Homo sapiens
ccgaggcgggtggatcacctgaggtcaggagttcaagaccagcctggccaacatggtggaaccatgtttctactaaaaatacaaaaattagcctggcgtgrtggtgggcacctgtattcccagctactcgggatgctgaggtgggagaattgcttgagcctgggaggcagaggttgcagtgagctgagatcatgctactgc

SEQ ID NO: 32846 - DNA, 201 bp, Homo sapiens
agaaaacaaaaacaaataggacccatatccctggattgttgaggaaatacgtgaacatatgtggcacacattatagtgtctggcatacaataaatactttstaatgttactggtgtcttcttaccgttattgtctcactggtgaccgtttgaaatgttgaagctttattattacagataatggtggatatagtctcttcct

SEQ ID NO: 32847 - DNA, 201 bp, Homo sapiens
tccccatttgttgtttttttgggacccagggtatcagtcatctgatcattgtgtgactttctcaaggacctttacttgagtcttgcacctctggtccacartgtccacataccagcttgatggtgacttgtgtcattctccatccccttgttaagagaaaatctactttatgagccctctttccaaccgcagtgttgagga

SEQ ID NO: 32848 - DNA, 201 bp, Homo sapiens
ttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaac

SEQ ID NO: 32849 - DNA, 201 bp, Homo sapiens
aaaattagccaatgtggtggtgggtgcctgtagtcccagctactcgggaggctgaggcaggacaatggcgtgaacccaggaggcggagattgcagtgagcygggattgtgccactgcactccagcctgggtgacagagcgagactctgtctcaaaaaaaaaaaaaaaaatagtagattgtttgcctcagttgggaaaaaat

SEQ ID NO: 32850 - DNA, 201 bp, Homo sapiens
atgccagatgcagtgcctcatgcctgtaatgtcagcactttgggaggctgaggcaggtggatcacttgtggtcaggagtttgagaccagcctggccaatayggcgaaaccctgtctctactcaaaatacaaaaagttagccgggcgtggtggcacgtgcctgtaatcccagctactgaggaggctgaggcaggagaattgc

SEQ ID NO: 32851 - DNA, 201 bp, Homo sapiens
cttgaactcttgacctcaagtgatccacccgcctcggcctccgaaagcgttgggattacaggtgtgagtcagagcacccggcctcaaagtgactttaacarcaacttaaaggcggtggctagctctgccccattcagtatggtagccactggccatgtgtggcagttgagtgcttgaaaggtagttagtccagattgaaat

SEQ ID NO: 32852 - DNA, 201 bp, Homo sapiens
aatcaagtttctttcagtcatgtatgatccattgggctttatataacttttagcctttgctttgcagggacagcaaagatgtgagcaaatttgtgcaaacytaatagggtgaaaaattgaggtatgaattagtaaagtcatttgtccttctggaaagagttatggattaacagattacatttgggtatattgtggttgtga

SEQ ID NO: 32853 - DNA, 201 bp, Homo sapiens
taaggagcagggggccccttccatccgtagagggcagaaaggtgcctatcatgtcttcagtgtcagtgccctggtatggagctagctggccttccacaggktctggagttaatgctggagagaagtaggggtggcagagcctaccctgtgttcctaggggggttcatctggagctagtccctgacccttaggtggaagatg

SEQ ID NO: 32854 - DNA, 201 bp, Homo sapiens
aacgcatcacaagtcacagggcttatctccattgttctgaacgatctgtagctaaacaaaaagataaaagctattaatattattaatagttgtagattacmgggaagagcgcatcctaaatcagccattagatttgttcctcatttctttgctttacaaattgtttttctgtatagtattggattttcaataaataaagta

SEQ ID NO: 32855 - DNA, 201 bp, Homo sapiens
ggaattccatgcaatctcctttgacactaaaagcttaagtcccatgatttgcctttgtggatggaaggccttggccttcttttatgatatatgtgttgggsggaggcatgtggtatgtggggcgggtaaaatacgagcctcatgcctgtctaagctggtgacttggcttggaaaagatgatcattcgtcaacgcatcacaa

SEQ ID NO: 32856 - DNA, 201 bp, Homo sapiens
ttcaggttttcaatagagttgatatcgggtctatttattttgtgggagtgaagggatagggatagtactgacagcattatgtgattgcagcctcattgatwagcatcggaaataatgactttaacattattttcagatagggagcactcagtaccaaccattatattaggctcatgggctcaacattttgctgtgcttttc

SEQ ID NO: 32857 - DNA, 201 bp, Homo sapiens
aaggaggtagggtagagtgggagcagatggacctgatgtcatccatctccctacgttgtttgcaggaggaaaagggatgaggctgaggctgggaggcaggsgcggtggattgagagagaggagagggattgttatgagtaaccaatgttcctcatgcctgccaggccctcactagatctgtttaacagagagtgcagaaga

SEQ ID NO: 32858 - DNA, 201 bp, Homo sapiens
ctatgtgttaggaatccatgtgagttctctaagtctgggacaacgataggtgtgtctgagtcctgcattaccatggtttattctttcctttacccagtatstattggagttgggcttctgttgctttatttctcggggtctggcatatcccactccctgtcttgagatctcaggacctctgaggggcattgcatgtaaaga

SEQ ID NO: 32859 - DNA, 201 bp, Homo sapiens; identical to SEQ ID NO: 14898

SEQ ID NO: 32860 - DNA, 201 bp, Homo sapiens; identical to SEQ ID NO: 14899

SEQ ID NO: 32861 - DNA, 201 bp, Homo sapiens; identical to SEQ ID NO: 14900

SEQ ID NO: 32862 - DNA, 201 bp, Homo sapiens; identical to SEQ ID NO: 14901

SEQ ID NO: 32863 - DNA, 201 bp, Homo sapiens; identical to SEQ ID NO: 14902

SEQ ID NO: 32864 - DNA, 201 bp, Homo sapiens; identical to SEQ ID NO: 14903

SEQ ID NO: 32865 - DNA, 201 bp, Homo sapiens; identical to SEQ ID NO: 8754

SEQ ID NO: 32866 - DNA, 201 bp, Homo sapiens; identical to SEQ ID NO: 14904

SEQ ID NO: 32867 - DNA, 201 bp, Homo sapiens; identical to SEQ ID NO: 14905

SEQ ID NO: 32868 - DNA, 201 bp, Homo sapiens; identical to SEQ ID NO: 14906

SEQ ID NO: 32869 - DNA, 201 bp, Homo sapiens; identical to SEQ ID NO: 14907

SEQ ID NO: 32870 - DNA, 201 bp, Homo sapiens; identical to SEQ ID NO: 14908

SEQ ID NO: 32871 - DNA, 201 bp, Homo sapiens; identical to SEQ ID NO: 14909

SEQ ID NO: 32872 - DNA, 201 bp, Homo sapiens; identical to SEQ ID NO: 14910

SEQ ID NO: 32873 - DNA, 201 bp, Homo sapiens
atatggtttggctgtgtccccacccaaatctcatcttgaattgtagctcccataattcccatatgttgtgggagggaccgggtgggagaatattgaatcaygggggtggttcccccatactgttcttggggtagtgaatgaatctcatgagatctgatggttttataagggggaaacacctttcacttggctctcattttc

SEQ ID NO: 32874 - DNA, 201 bp, Homo sapiens
atagaataaaatatcatcaggagcagctcatgtgaccagaatgtgacaaagtctttgctctacaggtcaagttgggacttactgaggagaaatgaggggamttcaaagtccaggttgcaccatccactttatagatgaggaaagtaagaacccacagcatcttgcacgtagaattcaatatatgtcctgcttcttgaatca

SEQ ID NO: 32875 - DNA, 201 bp, Homo sapiens
tctaagctcgtgattaaataaattctgaccctactctgataaaagtgaacccttgtggctggtcgcagtggctcatgcttgtaatcccagcactttgggaygccgaggcaggcagatcacctgaggtcaggagtttgagaccagcctggccaacatggtaaaaccccacctctactaaaaatacaaaattagtcaggcgtg

SEQ ID NO: 32876 - DNA, 201 bp, Homo sapiens
ctgtaattccagcactttgggaggctgaggtgggaggatcactggaggtcgggaatttgaaaccagcctggccaacgtggcaaaaccccatttctactaaraaaaaaaaaaaaaaaaaaaaaaaaagtatatatatatatatatatatatatatatatatatatatatatatatatgtagccatgcatgggggcctgccct

SEQ ID NO: 32877 - DNA, 201 bp, Homo sapiens
tctgtaattccagcactttgggaggctgaggtgggaggatcactggaggtcgggaatttgaaaccagcctggccaacgtggcaaaaccccatttctactaraaaaaaaaaaaaaaaaaaaaaaaaaagtatatatatatatatatatatatatatatatatatatatatatatatatgtagccatgcatgggggcctgccc

SEQ ID NO: 32878 - DNA, 201 bp, Homo sapiens
aggatccatgtttgatccgggggaataaagctagagttgctttcttccttgtaatatgtataatgactcatgagagaattccccactgtcttccccacctragacctgagaggaggagaaggaagcttggagtcgctgccctgtggcctgaattggtcagtgaccaatcactcagacccagctgacaggctatacgcggac

SEQ ID NO: 32879 - DNA, 201 bp, Homo sapiens
gcatctctggaggctgagcacctagtagtgattccaggtacgtagcaggtattttacaggtgcttgttgcattaatgcactttattggtgatatggtttgkctgtgtccccacccaaatctcatcttgaattgtagctcccataattcccatatgttgtgggagggaccgggtgggagaatattgaatcatgggggtggtt

SEQ ID NO: 32880 - DNA, 201 bp, Homo sapiens
cacacctggctatttttaattttagtttctgtagagacagagacttgctgtgttgcccaggctggtctcaaactcctggcctctcaagccatcctccagcmtcagcctcccaaagtgctgggattacaggcatgagccaccccacccagcccatgttaattttttcacctacaaaatgaaggctacaatatttactttgca

SEQ ID NO: 32881 - DNA, 201 bp, Homo sapiens
aagacatctccttctcatatgtttaggcaagcgttgatgacatcaacctagccttttattttaaatcccctgtcaacgcaattagataatacaaaaataasaaaactataggaggttgaggatggggctgggggccaaggagattacttggtttgaaatgaataaattgtctatcgtaagggaattctttggtgcatttta

SEQ ID NO: 32882 - DNA, 201 bp, Homo sapiens
atctcgtgagacttattcactgtcacgagaacagcatgggaaagacctgcccccatgattcagttacctcccaccgagtccctcccatgatacgtggggakgatgggagatacaattcaagatgagattttggtggggacacagacacaccatatcatgtcttggcagccatctatattcaagacactattctaggtatga

SEQ ID NO: 32883 - DNA, 201 bp, Homo sapiens
tcatggcggaaggcaaaggaggagcaaaggggcgtcttacatggtggcaggcaagagagcctttgcaagggaactgccctttataaaaccatcagatctcrtgagacttattcactgtcacgagaacagcatgggaaagacctgcccccatgattcagttacctcccaccgagtccctcccatgatacgtggggatgatgg

SEQ ID NO: 32884 - DNA, 201 bp, Homo sapiens
tgtcctatattagtctattctcacactgctagtgaagacatacctgagatggggtaatttgtaaaagaaagaagtttaacggactcatagttgcacatggstggggaggccacacgatcatggcggaaggcaaaggaggagcaaaggggcgtcttacatggtggcaggcaagagagcctttgcaagggaactgccctttat

SEQ ID NO: 32885 - DNA, 201 bp, Homo sapiens
tgctcatagtttaagtcatcaggtggtgactggaggagccagaaggtccctttgggcctgtcctctcaccagcatcaactgcaccaaaaagatctcattcygattatcagggatgaacccccccactgggtgatcaggcaaactacatgcattttaaaaaactatatcctgctgggtgcagtgcctcatgcctgcaatccc

SEQ ID NO: 32886 - DNA, 201 bp, Homo sapiens
gcctcagtgatcttctataacataagttgatagtcaataattgcttaatgggaatcataaatatgagtttatttatatgtgtatatatatatatatataawatatatttccatgaatatactgaatgctaagccctccccactttttttttcttttttaaattcagaaatttctagttgtgtttattcccctcgtcagcat

SEQ ID NO: 32887 - DNA, 201 bp, Homo sapiens
aagggcctgtctctcaggaaagcagtgatttcctttcacaataaccctatccttactgttgaagacttgtggaaaagggacatggcccagggaaccagagyggtttgggaaagcactttgtcaagaggcttggggaccccagggtggaagctgccatgcgcatgaggctgtgttagcagaggcagtggcagaagaagacat

SEQ ID NO: 32888 - DNA, 201 bp, Homo sapiens
caagtccttccggggactttgctgccacagttgacagggggaggtatttgcataacttcaccacacacagctaagctggtgatcctgctgcttggcagcaycttcccagcgtacaacagaggaaaactgcctgttgtagttaaaaaaaaaaagagagagagagagagagactgatacacaaagagaatcagaaaggagtag

SEQ ID NO: 32889 - DNA, 201 bp, Homo sapiens
tcctggccaacctggtgaaactctgtctctactaaaaatacaaaaattagctgggcatagtgttgtgtgcctgtaggcctagttacttgggaggctgaggygggagaatcgcttgaacccaggaggcggaggttgcagtcagccgagattataccactgcactccagcctggtgacagagtgagactccatcttaaaaaaa

SEQ ID NO: 32890 - DNA, 201 bp, Homo sapiens
gatgtcttgagtgagaaaatgctctgaccaataagccaatgttcaattgacttcgaaatgttatgtgggataggctcattcagggtggtacggctgtagasaaaatgctatatgcattggctgggcgcggtggctcacacctgtaatcccagcactttgggaggccgaggtgggcagatcatgaggtcaagagatcgaaac

SEQ ID NO: 32891 - DNA, 201 bp, Homo sapiens
taccaaaaaacaacaacaacaaacaaacagacaaacaaaattaggccaggtgtgatggcttatacctgtaatcccaacactttgggaggctgaggtgggakgattgtttgagccccggagttcaagactagcctgggcaacatagcgagaccctgtttcttaagaaaaaagaaacatttaattaaaaattcagaattggaa

SEQ ID NO: 32892 - DNA, 201 bp, Homo sapiens
agtacttggggttaatttagcaaaccccaggatccccagagggtccctcggtattgtggttttctcctcgcttccaccttatagtggctccaccaggaccycttgactcagccagcactccttctcaagtcacttcgcagcacaatccgtttgttgttgctgttgttttttcttttgttttgttttgggtttttttttttg

SEQ ID NO: 32893 - DNA, 201 bp, Homo sapiens
acattaaatcttccataatctgtgctagttcggcaaagaagccccaacgtcctcccaatcatagggcgcctgagctcttggtctcctatatcttatattcrttatagatgtcttatatccattcctgtatcctttgtgatgtcttgagtgagaaaatgctctgaccaataagccaatgttcaattgacttcgaaatgttat

SEQ ID NO: 32894 - DNA, 201 bp, Homo sapiens
aagaactatgtgtgttttcacttcttctttctttagagaaaacaaatatcatctgccttgctaggtagttgtgagaaatgaggagataatatctttaaatmtcctacggtgatacctggaacatgatggtgcttgggaaatgtctcttcttctgaaatgaggctgcctcgaagactcactggaacccaagcaaagtgtctc

SEQ ID NO: 32895 - DNA, 201 bp, Homo sapiens
gctgcagaacaaatcaccccaaaattcagtgattagtttataggtagccccatttcacccatctcattctatagctcaggttgaaagttgagtcatgaatyggggaacattcttctcttggtgtaaattagtcaccagtgtctcatagggttgggctgaaacttaacacatcccatcactttgattggctaaagtcagtta

SEQ ID NO: 32896 - DNA, 201 bp, Homo sapiens
atcttcactccatgtaattagttagctattgctgcagaacaaatcaccccaaaattcagtgattagtttataggtagccccatttcacccatctcattctrtagctcaggttgaaagttgagtcatgaattggggaacattcttctcttggtgtaaattagtcaccagtgtctcatagggttgggctgaaacttaacacat

SEQ ID NO: 32897 - DNA, 201 bp, Homo sapiens
tttatgaggctttttttaatctagaatatatggaaatcttttcttgaagcacaatataatattgaattgggaatgttgtctgacagtttccctcttaccgktgcatagaatgactctcctgtatgaatttttaaaagaaacttcaatatgctatgcatttgaaagggaagaagtaatcaccataatcttgaggtatctttt

SEQ ID NO: 32898 - DNA, 201 bp, Homo sapiens
gctgggcacagtggcccacacctgtaatgccagcactttggaaggccacagtcggcagatggcttgagcccaggagtttgattccaacccgggcaacataytgagaccccatctctactaaaaatacaaaaattagccagtgtggtatcatgtgtctgtggtctcaggggtctcaggtacttgggagactgaggagggagg

SEQ ID NO: 32899 - DNA, 201 bp, Homo sapiens
ttaaaagccagaaacaactggctgttagctgtcacaatattaatactagtgtgtgcaagtaagtttgttttctgcttctgtcttacacgttttacgggctrtcagtagatgcatctaataatcctaacactgtcatccttatacttgaggtcttattgtccacttctaccttagctatgtaaacagatgagtaacctactc

SEQ ID NO: 32900 - DNA, 201 bp, Homo sapiens
agggagtcattattactctaccacaaccactaattctggacttcacgttccctcatccatagagcagggataacaatatcctccaggctatccgcggaagwagagaatataagctttatccagggggccactcagtgatgggagtcttccttatgaagctgtcccagctccatctctcaggactgaaatgtgggtaagacc

SEQ ID NO: 32901 - DNA, 201 bp, Homo sapiens
gtcatacaaccatatggtacctctctggcaactaatttcacctatttccttatttgtttaaaaattttaacttaaattttttcccctcaagatctatttayggatcatcagttttattttttcttttctttcctctttttcttttgctcccttttctccccactcttgactcttctctagtttttatatgcagtttgtatt

SEQ ID NO: 32902 - DNA, 201 bp, Homo sapiens
ggcatgaaacttgatttgaccaatgaggcatttggaaacacggcacaagcaaaggcttgaaacgtgcttttatgttggtgcttgcccacttgctgtgctaygaacccttttacttctgggtgcgaacaagcccaggctagccttctgggcgatgagagacacaagaccatgtttccatattgccccagccaagagccaacc

SEQ ID NO: 32903 - DNA, 201 bp, Homo sapiens
agataccaataattaatatctatggttgattgtaaaaatggccaccaattcttccctgtcccctgcatatgtacatccttgcactgtgaaattgtagatcycgccctccaaaggtgaagttcgtttgtccactccttgaaccaggatggcatgaaacttgatttgaccaatgaggcatttggaaacacggcacaagcaaag

SEQ ID NO: 32904 - DNA, 201 bp, Homo sapiens
ctttccttgactttgatgtctaggtctggatttcaagggctcagaaactctctcatgcatgtagttccctcctgctttgaatctctctgactttccttgaytttgatgtctaggtctggatttcaagggctcacgtgatgaggatagtttctttatcttaagggcaactgatgtggagtcttaattaacactggcaaaatc

SEQ ID NO: 32905 - DNA, 201 bp, Homo sapiens
tatgagcaaggcaaaagggacaatgttcaccctttggactggaagtaagaagcccctgcagttccaaatgactccacatttggaatgatttcacaaggagygcaaaagaagcctcttgtttgactttgcccacaaatgccagaggaggactcttctgagccatgccaataagaaaaatgagaatgccagcttaaataaatg

SEQ ID NO: 32906 - DNA, 201 bp, Homo sapiens
tggcagattgagtgtttggcaacggcccactttctggttcctagatgttcacctccttgctatgtcctcatatcgggggaggggcaaagggtctctctatytggcctcttttaagcccttaacccattcatgaaggctttgcctcaatgacctaatcacctcccaaaggccctacctcctaatatattatattggtgatta

SEQ ID NO: 32907 - DNA, 201 bp, Homo sapiens
tctcatagttcttgaggctgggaagtccaagatcaagctgctggcagattgagtgtttggcaacggcccactttctggttcctagatgttcacctccttgytatgtcctcatatcgggggaggggcaaagggtctctctatctggcctcttttaagcccttaacccattcatgaaggctttgcctcaatgacctaatcacc

SEQ ID NO: 32908 - DNA, 201 bp, Homo sapiens
ttgtttgtaagaatcagttgaggacagatgggactatttgcatggattggtgtcatgtttgaagtcagttaccagagggtttctttcaacagagtatcccmaaaaaaaaaaaaaaaaaaaaaaaaaaaaagtaaattgcacagaccccagcttaggacctggacttaatcttcatgatgtttgtaaagtaatacttcttgg

SEQ ID NO: 32909 - DNA, 201 bp, Homo sapiens
tccttatctgtaaggtggcagttacaataatacccacctcccagggttatatgtcaatgggttaggcacagacctaggaactcagcaaatggactactatsaagtattagctttttactgtttctggttttctgatttttgtctcctgttgtgaacatacgttgcttttgtaatatgaaaaataaaaaataaaagttaaat

SEQ ID NO: 32910 - DNA, 201 bp, Homo sapiens
tctatcatgaattggctgtgaggtgtgacattgaaaaagtgatttagcctttgttcccctccaggtccttatctgtaaggtggcagttacaataatacccmcctcccagggttatatgtcaatgggttaggcacagacctaggaactcagcaaatggactactatgaagtattagctttttactgtttctggttttctgat

SEQ ID NO: 32911 - DNA, 201 bp, Homo sapiens
atacaattaatttagattttttaaaaggcttttgagaatattcggagaacctaatatattttgagacctgacatttattttaaacgtgaaaagcaatttasaaaattgcacatactctataaatacacttctgttataaaaatagacacgtacggccgggcgcggtggctcacgcctgtaatcccagcactttgggaggcc

SEQ ID NO: 32912 - DNA, 201 bp, Homo sapiens
ttcttgggctagttggtatagcttccttctcagctcattctgcaaggtttgctttggaaaagtctgtgcatctgagctctctcttgccatatcaggaaccsaagtcagaaataaaggctacagatgctcaaaatctgcagtattcaatctttttaaggcccagcatggtgtctcatgcctgtaatcccagggctttgggag

SEQ ID NO: 32913 - DNA, 201 bp, Homo sapiens
aaatacaggcctttcccatttcacagtgtttctagctcccctttccaatacatctctctctctctttctctctctctctctctctctctcacacacacacmcacacacacacacacacagccaaatcagacaccaacataaactgtagagttaacattctttttccaccctcacactttttttagctccgatctgtgttca

SEQ ID NO: 32914 - DNA, 201 bp, Homo sapiens
attcagtacatatttataaaaccacacttacatttaaatacaggcctttcccatttcacagtgtttctagctcccctttccaatacatctctctctctctktctctctctctctctctctctctcacacacacacacacacacacacacacacagccaaatcagacaccaacataaactgtagagttaacattctttttcc

SEQ ID NO: 32915 - DNA, 201 bp, Homo sapiens
gcaatgatgcccagagcatttatctttgatgctgggaatgcgttcattttctttatcttgccattactgtacctctattgggaaatttactctctcttcakagataggatccgattcagtacatatttataaaaccacacttacatttaaatacaggcctttcccatttcacagtgtttctagctcccctttccaatacat

SEQ ID NO: 32916 - DNA, 201 bp, Homo sapiens
atatccttaggtttaagatacaggcaccacaacataaaccacccccagagtacacatgcatgggtgtaatttggtgccattctcctcccttttgcccccaycaaaatgaagtttttagtgtaaatgtcatgtagattttaaccaaaggttgattggagggtctgagtttctcagctaaatgaaggcatgaggactgtatcc

SEQ ID NO: 32917 - DNA, 201 bp, Homo sapiens
agcattcattaagtgttccctcctattatatccttaggtttaagatacaggcaccacaacataaaccacccccagagtacacatgcatgggtgtaatttgktgccattctcctcccttttgcccccaccaaaatgaagtttttagtgtaaatgtcatgtagattttaaccaaaggttgattggagggtctgagtttctcag

SEQ ID NO: 32918 - DNA, 201 bp, Homo sapiens
cccccaccttattctaaataatgactttcttaaaactacatgttttgggggaatgtcctgcaatattgctttacatctttttatttttttattttattttwttttttttgagacagagtctctgtctccaggctggagtgcagtggcacaatctcagctcactgcaacctccacctcccgggttcaagcgattccactgcc

SEQ ID NO: 32919 - DNA, 201 bp, Homo sapiens
ctagtatttgccaaaactagaggatgaatgagtgatgggtaagagagttctcagaaaaatggatataaacaatattgtaaatcatatttggaaaataaatrctagaatcattgaatccctgagttatagaaaaatttattaatagcgctatctggctactttttaaagtgtggacatcctcgatgtattagctatgcatct

SEQ ID NO: 32920 - DNA, 201 bp, Homo sapiens
tccccagtaaccagtacagtgccagatacagagtagtaaccctacattctagcgtaggcaaatattctagtatttgccaaaactagaggatgaatgagtgrtgggtaagagagttctcagaaaaatggatataaacaatattgtaaatcatatttggaaaataaatactagaatcattgaatccctgagttatagaaaaat

SEQ ID NO: 32921 - DNA, 201 bp, Homo sapiens
aaatctcataatgttttaagaaagtttatgaatttgtgttgggccagattcaaagttgtcctgggccgcatgtggcccaccagccatggtttggacaagcytagtctacaggttcttcaagaggggcttgagcatttgaaagacttctagtgggagagatcacaaggtacaagtagaaaatcctgggctggcctgagaggc

SEQ ID NO: 32922 - DNA, 201 bp, Homo sapiens
tggctgcacataatatacaattgttgatgagctaaaaaaaaaaaaatccccaaaaaatctcataatgttttaagaaagtttatgaatttgtgttgggccasattcaaagttgtcctgggccgcatgtggcccaccagccatggtttggacaagcttagtctacaggttcttcaagaggggcttgagcatttgaaagacttc

SEQ ID NO: 32923 - DNA, 201 bp, Homo sapiens
catcctcagaactcctcccagtgcctctcaatggctaaaccaaccaaaggttggagctcaaggaagctcctgaggctatctttacaggtcagccagttggraacagagttgacggagaggggacaggaggtgactagatttggaaggaaaattagaaaacttttggccgggcatggtggctcatgcctgtaatcccagcac

SEQ ID NO: 32924 - DNA, 201 bp, Homo sapiens
agaaattaagcagaaaacagaggtctcaatttgccttttcagcgtgaatgcagactcttacattcagtgctgggagtctttcttgagggacagtgagagcraggaagggtttccattctccgagatggatggttgcattagtatttatttcctttttgtttttccttaggatgagaaagaaggcagtggagcccttttcct

SEQ ID NO: 32925 - DNA, 201 bp, Homo sapiens
gtgaccctgtagaatgcactgaagcaaaaataacaggtaatgctaatcataaagttttacaaatctcctgaagagtcttgttggtttccgtgttgatgaarcaggaaatttccctgacccctttgcaggcaggaagtggagtgcggatgctggaactagctggctgctttggtgccagtagaggtgaactgcactctcttg

SEQ ID NO: 32926 - DNA, 201 bp, Homo sapiens
ttcaccgtgttaggcaggatggtctcgatctcctgacctcgtgatccacccacctcggcctcccaaagtgctgggattataggtgtgagccaccatgcccrgccctcagagtgttttaaaatgcatactattaaatacctaggattataaagggagccagctatacttacatatagttctctctgtgaccctgtagaatgc

SEQ ID NO: 32927 - DNA, 201 bp, Homo sapiens
tttcaccgtgttaggcaggatggtctcgatctcctgacctcgtgatccacccacctcggcctcccaaagtgctgggattataggtgtgagccaccatgccmagccctcagagtgttttaaaatgcatactattaaatacctaggattataaagggagccagctatacttacatatagttctctctgtgaccctgtagaatg

SEQ ID NO: 32928 - DNA, 201 bp, Homo sapiens
acacctggcaattttttttttatttttagtagagatggggtttcaccgtgttaggcaggatggtctcgatctcctgacctcgtgatccacccacctcggcytcccaaagtgctgggattataggtgtgagccaccatgcccagccctcagagtgttttaaaatgcatactattaaatacctaggattataaagggagccag

SEQ ID NO: 32929 - DNA, 201 bp, Homo sapiens
catgccatcacacctggcaattttttttttatttttagtagagatggggtttcaccgtgttaggcaggatggtctcgatctcctgacctcgtgatccaccsacctcggcctcccaaagtgctgggattataggtgtgagccaccatgcccagccctcagagtgttttaaaatgcatactattaaatacctaggattataaa

SEQ ID NO: 32930 - DNA, 201 bp, Homo sapiens
ggaaaaggtgctactggcatctagtgggcaaaggccagggatagtgctaaggatcctgcagtgcaaaggagcatgcccaccacaaaatatcagcagtgccsaggttgggaagctctgtgccattgtgcaaagattcaaggtggctatgtcacaggactggtacatgtccttttttttttttttttttttttgagacggagt

SEQ ID NO: 32931 - DNA, 201 bp, Homo sapiens
ccatgtatgtgtcagtcctactatgcaccttacagctcactaaccctgtttaataatgtatgttgctacatttaatctttatggtagcctcatgaacaggytcttatttagttcagtggttcttgatcaggagtgatattgcctgccagggaatgcatgtcaatgtctggagacatctggggttgtcagttcaggagggta

SEQ ID NO: 32932 - DNA, 201 bp, Homo sapiens
ttagcattgtgataaataatatttaatatatagtaagggaggtcaaagtatgaactattttgattttttatgggtttttttttttttttttaaagaatgcrttgattttgtttttctttcttttttttttttttttttgaggcaggccttaggtctggcacccaggctggagtgcagtgacgtgatcaaggctcactgcag

SEQ ID NO: 32933 - DNA, 201 bp, Homo sapiens
tatatataaattctgagtaagtattaaccaaagaaatggaacatcaatattggttcccagtctagttcacaggtgttatcaagatggttacctttctaagkgtctttttatttcactagttccaaaagagtatctctcaaaatattaggtagtatttagtcaacactttaacacataacttgtttttttttttggcataag

SEQ ID NO: 32934 - DNA, 201 bp, Homo sapiens
gtctactgaattatgtgggattcaacaggggatacaaatggatttgaattctgtaactgtcatattgtggtccggagagggtggaaactgaagtatccctytgcgtcgccacatctgtcaaaagtcctcagcgctccccgcaatccatgtctggtggaagcgcgaggtggtgaggatggaaagggcatgcgttgacttcat

SEQ ID NO: 32935 - DNA, 201 bp, Homo sapiens
agttcacagggatgccttcggtccagacactatgaccgttgacgaaggatttgaaatattttgagaactctgaaataatgcacaccagaaacgtccagctsaaaacaaaaagggaacaagatgacattttgcaatcccatgcacgttgcaggcgcgttgaatgtgaaggtcagtagtacttcagagggcaggcctgttgcc

SEQ ID NO: 32936 - DNA, 201 bp, Homo sapiens
tggtctcaaactcctgacctcaagtgatccacctgcctcacctcccaaagtgctgggattacagtcgtgagccaccgtgccggccactttcatctttctgwttaactgaaaagtatcaagcaatgcttacatgtaactgcactttctcatcaactgcaaccataatttagctatggatacaagagttgggcacaaatccat

SEQ ID NO: 32937 - DNA, 201 bp, Homo sapiens
cttatgagtcacttatgcccttgaagagtgagtgatgtatcaaaatatgtctgtctttattgtttcactttcatccttctttttttggagatggagtcttsctctgttgaccatgctagaggtggcgcgatctccactcaccgcaagctccgcctcctgagttcaactgattctcctgcctccgcttcccaagtacctggg

SEQ ID NO: 32938 - DNA, 201 bp, Homo sapiens
tggaaaccagcccaggcaacatagtgagacctcatctctttaaaaaaaaaaaaaaaagaaagaaaaattagctggcatggtggcacatgcctgtagtcccmgcttctggggatgctgcagcgagccatgattgtgccactgctctctggcctgggcaacaaagagagatcctgtctccaagtctgtctgtctgtctgtctg

SEQ ID NO: 32939 - DNA, 201 bp, Homo sapiens
ctatttacaccacggaaacaggcaaaaactactgatcaagccttcactgttttgtttatattgtcttgacttagaaagtgattgcaatgttaataatgcasattaaattgaagcgtacagtgcctataaaccattacattatgaatagtataaaaaattgaggaagccgtgtggctcacaaattcagcactttgggaggcc

SEQ ID NO: 32940 - DNA, 201 bp, Homo sapiens
cagccctgcattcagggataccaacttgggtgctgaaaagcagcgatggcaggactatttacaccacggaaacaggcaaaaactactgatcaagccttcaytgttttgtttatattgtcttgacttagaaagtgattgcaatgttaataatgcagattaaattgaagcgtacagtgcctataaaccattacattatgaata

SEQ ID NO: 32941 - DNA, 201 bp, Homo sapiens
gcaggaactcgcttgaacccgggaggcggaggctgcagtgagctgagtttgcaccactgcattccagcattggtgacagagcgagactcagtctcaaaaamaaaaaataatataataataataataatcgcacctcaatactccgtagccattttaccgcatgtgactattagctgtgcttttgcggttatctacgtctgt

SEQ ID NO: 32942 - DNA, 201 bp, Homo sapiens
ctctactaaaaaatacaaaagttagccgagcgtgatggccagcacctgtagtcctagctacttaggtagctgaggcaggaactcgcttgaacccgggaggyggaggctgcagtgagctgagtttgcaccactgcattccagcattggtgacagagcgagactcagtctcaaaaaaaaaaaataatataataataataataa

SEQ ID NO: 32943 - DNA, 201 bp, Homo sapiens
ccagccctttgggaggccaaggcaggcagatcacctgaggtcagaaattcaagaccagcctggccaacatggcaaaaccctgtctctactaaaaaatacaraagttagccgagcgtgatggccagcacctgtagtcctagctacttaggtagctgaggcaggaactcgcttgaacccgggaggcggaggctgcagtgagct

SEQ ID NO: 32944 - DNA, 201 bp, Homo sapiens
cctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctgga

SEQ ID NO: 32945 - DNA, 201 bp, Homo sapiens
tttgactccctccacccccggaaggtatattcagagtctccaagactgcctccgcctactcacatgtttatggcccggtgagaccgcatcctccctttctmtatctgtcccttttctggatgcagggacacagaatcccctaagtgggaagagctttggagtggaggctgttcaaagttctgtggtgattaattattacct

SEQ ID NO: 32946 - DNA, 201 bp, Homo sapiens
gatacctagactctgctgggctctagagaagtgctgggctacagcgcccagtgccctacctcttggggccagccagcctcaccaaaaaatcaggcttctgkcttgctccaaactcaggaagttgctgggaagtctggctagcaacaccctcattcccagtcctggccatgcctctctgctctccctagcacagggagcatg

SEQ ID NO: 32947 - DNA, 201 bp, Homo sapiens
tagatttggcctgggcagcccagggagactgttcgagcactggatacctagactctgctgggctctagagaagtgctgggctacagcgcccagtgccctasctcttggggccagccagcctcaccaaaaaatcaggcttctggcttgctccaaactcaggaagttgctgggaagtctggctagcaacaccctcattcccag

SEQ ID NO: 32948 - DNA, 201 bp, Homo sapiens
gtttgatagatttcttttatgattaattctcctattaagttttaatgacttcaaagatacaaagctagaaactacaaaactaggcatggttaataaataastgaaataccaggtgtatagaaatgcatctgtggaaaaatgaaatcatatattctctaggatatattaggaaatggctctttggcaagtctagagggtaaa

SEQ ID NO: 32949 - DNA, 201 bp, Homo sapiens
tttgcatttttaaaactgaaagaacatttccacaccattagaaataagatttcttcttaaaaatattcacaaggtgcaaacacttacatgtgtatatgcaygatttcaccaccagggggcattgtggtttgactgtccagttaaagagcctgtgttctatcagtttacccagaaactagaaggcctgcgagtatttctgat

SEQ ID NO: 32950 - DNA, 201 bp, Homo sapiens
gtgattttgataaactaaatgcatctttaattttactcacagcaaagcgattctttattttctctctaaaagcataattgatgtgccatgatctttgtctktgcatttttaaaactgaaagaacatttccacaccattagaaataagatttcttcttaaaaatattcacaaggtgcaaacacttacatgtgtatatgcatg

SEQ ID NO: 32951 - DNA, 201 bp, Homo sapiens
gcagtgatgtctatgacactgggcaagtgtcttaaaatgttgtgcatcagaaaaaagtcatcattgccaaggccagcagatctcgaaaagggggctgggayacgttggtgatttttttcatgctctacttacagtatgactcgtaactgttaatggctgagctcctccttaggtgaagaaggaaggcaatggcgttttcta

SEQ ID NO: 32952 - DNA, 201 bp, Homo sapiens
tgaaaaacttttttggagcagcacctgcatgttgtaaaaacacaaaataaaaaaaaaataaataaaagcagaccccttggttcagatatctttgtttgtgwaaatgttttggcattctttgtgaaaatcttcagattttcaagagcttaagatgacctcctctagccggctgcagcagtgtctaggtatctgtgaatgtgt

SEQ ID NO: 32953 - DNA, 201 bp, Homo sapiens
aagggacattgttgtttcactaattctgtaaaggagagcagcggcatttacttaggccgattccccattctctctttctgtttttaaacagagacagatcytgctctgttgcccaggctggagtgcagtggcatgatggcatgatcatagttcactataatctcgaactcctggtttcaagtagtcttcctgccttggcct

SEQ ID NO: 32954 - DNA, 201 bp, Homo sapiens
tgtctctactaaaaatacaaaaagaaattagctgtgcgtggtggcgggcgcctgtagtcccagctactcgggaggctgaggcaggagaatggcatgaacaygggaggtggagcttgcagtgagccgagattgtgccactgcactccagcctgggcaacagagcaagactccatctcaaaaaaaaaaaaaaaaagaaaagaa

SEQ ID NO: 32955 - DNA, 201 bp, Homo sapiens
tcgagaccattctggctaacatggtgaaatgctgtctctactaaaaatacaaaaagaaattagctgtgcgtggtggcgggcgcctgtagtcccagctactygggaggctgaggcaggagaatggcatgaacacgggaggtggagcttgcagtgagccgagattgtgccactgcactccagcctgggcaacagagcaagact

SEQ ID NO: 32956 - DNA, 201 bp, Homo sapiens
agggacagtggttgggtctggagatgtcacccttagctgtttttcacaatgagaggttgttttatcataaataaatcaataaatggcagattatacaccgkagttactgagaaatataaaaaaaaaaaaagcccacattttaaagggaatttggtatttttaacaaagcatcagggggccgggagcagtagctcacgcctg

SEQ ID NO: 32957 - DNA, 201 bp, Homo sapiens
attacgtttataattttcagttactagttaggtaaagaatcaaaattaataaacacatttatagttctcagagattccttgagagaggaacatctttaaayggataaccacagtcttctaaacacctgaaagggtgtcttttgctgaattatggagttttagttttgctttagaatttttggatgattagacttgtacttc

SEQ ID NO: 32958 - DNA, 201 bp, Homo sapiens
gatggtcatgttttactttgaagcaatctgtgcttggtttatttttttcagtgagtgtggattacgtttataattttcagttactagttaggtaaagaatmaaaattaataaacacatttatagttctcagagattccttgagagaggaacatctttaaatggataaccacagtcttctaaacacctgaaagggtgtcttt

SEQ ID NO: 32959 - DNA, 201 bp, Homo sapiens
ggccactgtgcccggccaggaagatggtcatgttttactttgaagcaatctgtgcttggtttatttttttcagtgagtgtggattacgtttataattttcrgttactagttaggtaaagaatcaaaattaataaacacatttatagttctcagagattccttgagagaggaacatctttaaatggataaccacagtcttct

SEQ ID NO: 32960 - DNA, 201 bp, Homo sapiens
ctgacctcaaatgattccctgcctccacctcccaaagtgctgggattataggtgtgggccactgtgcccggccaggaagatggtcatgttttactttgaascaatctgtgcttggtttatttttttcagtgagtgtggattacgtttataattttcagttactagttaggtaaagaatcaaaattaataaacacatttata

SEQ ID NO: 32961 - DNA, 201 bp, Homo sapiens
tgtgcttataagaaaagatatagaaagattagtagtagactgttgtgttctttttttttttttttttttttttgagatagactcttgcctgtcgcccaggytgcagtgcggtggcatgatctcggctcactgcaacttttgcctcctagattcaagcgattgtcctgcctcagccttctgagtagctgggattacaggcgc

SEQ ID NO: 32962 - DNA, 201 bp, Homo sapiens
cgccatcagatgaatggaggtttcttatgctgtggcgaaacccagggggtcaagcccctcggacatgacgtactgcaaagtgaggatgtttcattgatttrtatttttaaaattaaaaataattatttaagctgcatctgtgtgcttataagaaaagatatagaaagattagtagtagactgttgtgttcttttttttttt

SEQ ID NO: 32963 - DNA, 201 bp, Homo sapiens
agtgacagcccattcggagggttttaggcctgtccttagagaggcttgttatttcctctttcggtactttgttgcaacctagttcaccgccatcagatgartggaggtttcttatgctgtggcgaaacccagggggtcaagcccctcggacatgacgtactgcaaagtgaggatgtttcattgatttgtatttttaaaatt

SEQ ID NO: 32964 - DNA, 201 bp, Homo sapiens
ggctgatgttcatcgcacagtgacagcccattcggagggttttaggcctgtccttagagaggcttgttatttcctctttcggtactttgttgcaacctagytcaccgccatcagatgaatggaggtttcttatgctgtggcgaaacccagggggtcaagcccctcggacatgacgtactgcaaagtgaggatgtttcattg

SEQ ID NO: 32965 - DNA, 201 bp, Homo sapiens
agaggctgatgttcatcgcacagtgacagcccattcggagggttttaggcctgtccttagagaggcttgttatttcctctttcggtactttgttgcaaccyagttcaccgccatcagatgaatggaggtttcttatgctgtggcgaaacccagggggtcaagcccctcggacatgacgtactgcaaagtgaggatgtttca

SEQ ID NO: 32966 - DNA, 201 bp, Homo sapiens
aggatgaagcggaaaacctgagccacaaggcagtagaggttggacgagacactcattccgaaggcgggtgtgtatgtgcaaactgtataatttttttcttsttttctatctgctagcaaagtgggtaagttgacccatgacatggtccactggagggaccacatttgtgactctagcaattaagcctcccttctcatctgt

SEQ ID NO: 32967 - DNA, 201 bp, Homo sapiens
ttgcagaggaggggggcacagatgcctccagtggcccaagactcccctttacacattgccgttcccttgccttctactcctcttttcattacccttatcargattctgcagcccagggtgctgcttgttgatggacatcttcacctgactttctccctggtccaggtgcattttaagcatggaaggtgacacttgccattc

SEQ ID NO: 32968 - DNA, 201 bp, Homo sapiens
tactgcaaaacaggactcattagcaggagctcataaaatgaaactggcagtgagctcatatggaagaggcatcacgggcaactcggcttggctcaccagcycctgagctgcccccgagtgaccgctccagccttctttccttccacctctccctcttggccaacttcatgcttcagccaaagtgaactgagctcaccaggc

SEQ ID NO: 32969 - DNA, 201 bp, Homo sapiens
actaaacgatttgttcagattggggaaaaaaattttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaa

SEQ ID NO: 32970 - DNA, 201 bp, Homo sapiens
tgttctttctgccatttgggatgtgctttctgataatggcactaggctgccttgttgcctcctgcatgtagaacacagaacttcgcagtctctgcagagtrtctaaatcctgctctgggccagccctttcagaaacacttcaggagatcaatagttatctgcttacctttctagctgagatgagattttatgcttgttact

SEQ ID NO: 32971 - DNA, 201 bp, Homo sapiens
ttcttttcttttttcttttcttttcttttctacctctcgggattctgagagcatcctgtaatgttggaaagctttctgctaatccgggcattggagtgctytctgggttcactcctgacagttctttattgctttcccacctctgccaaggtcaaaaatggaacttgcttcttgttctcgtatcactcagactaagcagtt

SEQ ID NO: 32972 - DNA, 201 bp, Homo sapiens
gtttaattgacttccagttttgttttgttttgttttgttttgttttgttttgaaacagtctcactctgtcgcccaggctggagtgtagtggtgtgatctcygctcactgcagcctctgcctcctgggtttaaggaattctctgccttagcctcccgcgtagctgggattacaggtgcatgccaccatgcccagctgatttt

SEQ ID NO: 32973 - DNA, 201 bp, Homo sapiens
ccatattttgcaaagtcaagttggagatggctctcgatatgcatgagtgtgttagactgcttttcttctattttttaaaaatgcacccaaatgtaaaagayacttttacctttttgatttgatgttgaaggtcatttgaaaaatactctgtctttattctttgaaatggatttactctcaagaaagttgcatgtcacttta

SEQ ID NO: 32974 - DNA, 201 bp, Homo sapiens
atgaagtggctactataattatcctgatttcccaggcagagaaactgaggcttagagagttgaagtaatcaactgggtgttaaaaagctggtaagtggcasagcacttattggcgctaagactgtttctcaggaccttgttgtacgagagtcaacgataagacgcagaacgtatgtttcatttttcttgggaaggatctat

SEQ ID NO: 32975 - DNA, 201 bp, Homo sapiens
caggccttcctcccttacctctctctacctctatctcttctatctacctgtctctactccctctccctacttttctctttttcccagcctccccccgatayactcaacatatatctccctctccctccacccacctgcctcccccacactccttctttccctctcctctgcagggagagcttggaaaccaagagtctatga

SEQ ID NO: 32976 - DNA, 201 bp, Homo sapiens
ggcacgtttttcaacctctctgtgcttaatcttctcctctttaaaggtgggctagtgatagttacctcacaaggtagctgtgagaatgaaataatgatacrtaaagcacttataacaggacctggcatgcagtgagtatcagtgggtatttgctgtggttatttagttatctactttacatgtacatgtaaagaactaggg

SEQ ID NO: 32977 - DNA, 201 bp, Homo sapiens
gagtgcagtgacatgatctcggctcactgcaacctacaccttctgggttcaagtgattctgatgtctcagcctccccagtagctgggattacaggcatgtrccaccacaccggctaattttatgcatttttagtagagacgcgtttcaccatgttagccaggctggtcttgaactcctgaattcaaatgatctgcccacct

SEQ ID NO: 32978 - DNA, 201 bp, Homo sapiens
attagtgttgctgagataggagcttttggtagatggataaactgggatttgtaaatattttgcttagtttttttcccagagttttgcagaagagaataagktgttggtttgttataaggtggtcctttataaagtttagacctattttaataaggctgacttgggttgaagataactagagccatgactttcatcttgatg

SEQ ID NO: 32979 - DNA, 201 bp, Homo sapiens
gatgaggcctgggagtggcacaaatctttgaactccaggaggctaggaaacagagcataaccttgtgcccaggaagatgcggggcatagtacatctttgcytcacctgatgtattgtttgtttaaaatcactttggattctcatttaccttttccccctcaagatctttgtttttgactttggagataaccagaaataact

SEQ ID NO: 32980 - DNA, 201 bp, Homo sapiens
aaaccctgtctctactgtaaactccgtctctactataaatacaaaaattagccaggcttggcgctgggtttctgtaatcccagctacttaggaggctgagrcaggagaatcacttgaacccgagaggcagaggttgcagtgagccgatatctcacctctgcactccagcgtgggcaacagagcgagactccgtctcaaaaa

SEQ ID NO: 32981 - DNA, 201 bp, Homo sapiens
ggtgaaaccctgtctctactgtaaactccgtctctactataaatacaaaaattagccaggcttggcgctgggtttctgtaatcccagctacttaggaggcygagacaggagaatcacttgaacccgagaggcagaggttgcagtgagccgatatctcacctctgcactccagcgtgggcaacagagcgagactccgtctca

SEQ ID NO: 32982 - DNA, 201 bp, Homo sapiens
ccaacatggtgaaaccctgtctctactgtaaactccgtctctactataaatacaaaaattagccaggcttggcgctgggtttctgtaatcccagctacttrggaggctgagacaggagaatcacttgaacccgagaggcagaggttgcagtgagccgatatctcacctctgcactccagcgtgggcaacagagcgagactc

SEQ ID NO: 32983 - DNA, 201 bp, Homo sapiens
ttatgtgaatttcatctcagcaaaaagaggctaacacataaggagacatattttgatacatgtggcatattaagctgctgttgttgttttttaaatattcmagctgcgtgcagtggctcacacctgtaatcccagcactttgggaggctgaggtgggtggatcacttgaggtcaggagttcgagatcagcctggccaacat

SEQ ID NO: 32984 - DNA, 201 bp, Homo sapiens
ttacaggcgtgagccattgcacccggctattgggtacaagtttcctttggggtggtgaaactgttttggaactagaggtgatagctctacaacactgtcartgtactaaatgacactaaattgtacactttgaaataatttatgttatgtgaatttcatctcagcaaaaagaggctaacacataaggagacatattttgat

SEQ ID NO: 32985 - DNA, 201 bp, Homo sapiens
gactataggtgcccgccaccatgcttggctaattttttgtgtttttagtagagacggggtttcatcgtgttacccaggatggtctcgatctcctgaccttktgatcagcctgccttggcctcccaaagtgctgggattacaggcgtgagccattgcacccggctattgggtacaagtttcctttggggtggtgaaactgtt

SEQ ID NO: 32986 - DNA, 201 bp, Homo sapiens
ccattctcctgcctcagccttcctagtagctgggactataggtgcccgccaccatgcttggctaattttttgtgtttttagtagagacggggtttcatcgygttacccaggatggtctcgatctcctgaccttttgatcagcctgccttggcctcccaaagtgctgggattacaggcgtgagccattgcacccggctattg

SEQ ID NO: 32987 - DNA, 201 bp, Homo sapiens
gccattctcctgcctcagccttcctagtagctgggactataggtgcccgccaccatgcttggctaattttttgtgtttttagtagagacggggtttcatcktgttacccaggatggtctcgatctcctgaccttttgatcagcctgccttggcctcccaaagtgctgggattacaggcgtgagccattgcacccggctatt

SEQ ID NO: 32988 - DNA, 201 bp, Homo sapiens
atttagcatatttccttttaattgcccaggtaaataatacccaccatcagagggcaccagtagtgtaatcaccttattttttaaaatgtattctgtgtttyatgattttttctgaataactgatctttacagtctgaattgcattctgttgggcttgacttatttttaaattaaaagagactaacacattaaacactaaga

SEQ ID NO: 32989 - DNA, 201 bp, Homo sapiens
actgaactcagtcgtttcacctggctggggaggcctcaaaattatggcagaaggcaaaggaggagcaaaggcacatcttacatggcagcagacaagaaagygtgtgcaggggaactgccctttataaaatcaccagatctcatgagatttattcactatcaagggaacagcacaggcagatcccatggctttgactcagtt

SEQ ID NO: 32990 - DNA, 201 bp, Homo sapiens
gtgtatacatacatagaagtatatatataaataccagtactagtgtctgctaataggtggcgccactttttatctgtgtgtgttgggggtggaattagcaygtagaggttggcaaaggggacaggagactgtgggatgattagtatattcttatttggcctgggagggaaaaaaaatctttcatttccaacaatattcatt

SEQ ID NO: 32991 - DNA, 201 bp, Homo sapiens
gctgggcgtggtggcgggcgcctgtagtcccagctacttgggaggctgaggcaggagaatggcctgatcccgggaggcggagctttcagtgagccaagatygccctactgcactccagcctgagcgtgagactctgactcaaaaaaaaaaaaaaaaaaattagctgggcgtagtggcaggtgcctgtaatcacagctatcc

SEQ ID NO: 32992 - DNA, 201 bp, Homo sapiens
tgttaaaaaaaatttaattttgtttatgcatgtgtgcataaacaaagcaatagaaaatatttgatatttaagattgagcacttaacaaaatactttgtctytttttggtttgctgtcttaagcaatagccttaaattcttgtcccagggatacctgatagagctaatatagaacaatattttaacataatttgaagtattt

SEQ ID NO: 32993 - DNA, 201 bp, Homo sapiens
gttgggaagagggacacatttttaacatagacaccaaaagagaggctggaagagttgaccacttagaaatgtcacgagtgtctgtgaatagtgttgggggmtgagaggcaagagaagaaaatagtcctaatgttgtacaagtagcaatggaaacaaacttgttaaaaaaaatttaattttgtttatgcatgtgtgcataaa

SEQ ID NO: 32994 - DNA, 201 bp, Homo sapiens
ttgatgcaaaaaatatgataacatttcaaaatttaaatcaagacaaattcaatattatagcaaaggttcaagtaatgaacatgaatttgtaatgatgcctsggggaggtgaaggttaaaaaaaaaaaaaaggccaccaaggacctcatgttaaagttgatgatgacggaagtgagcagtgatgatgagatttaaaaaacta

SEQ ID NO: 32995 - DNA, 201 bp, Homo sapiens
gtgtggcttttctgtcttgaggatagatagaagaggagtcagataaagttgcagaacagagatgacgtctttactgagacttgaatgatgtgtcggaggcmaacatgttgacacaaacgagagaattttaggttctctttgtagctgtggctgggctgggacaaggacgatggacaaagttatgggggtgctaaaaacctc

SEQ ID NO: 32996 - DNA, 201 bp, Homo sapiens
gatgtgtggcttttctgtcttgaggatagatagaagaggagtcagataaagttgcagaacagagatgacgtctttactgagacttgaatgatgtgtcggasgcaaacatgttgacacaaacgagagaattttaggttctctttgtagctgtggctgggctgggacaaggacgatggacaaagttatgggggtgctaaaaac

SEQ ID NO: 32997 - DNA, 201 bp, Homo sapiens
gaatttcacttttgttgcccaggctgcagtgcaatggcacgatctctgctgaccccaagctccgcttcccaggatcaagcgattctcctgcctcagcctcytgagtagctgggattacaggcatgcgccaccatacctggggaatttttttttgtatttttagcaaggttgttgatcaggctggtctcgaactctcaacgt

SEQ ID NO: 32998 - DNA, 201 bp, Homo sapiens
gctgttttttttcccctaggttgtgtttttgtgtttttgtttgtttgtttgtttctttgtttgtttttgagacagaatttcacttttgttgcccaggctgsagtgcaatggcacgatctctgctgaccccaagctccgcttcccaggatcaagcgattctcctgcctcagcctcttgagtagctgggattacaggcatgcg

SEQ ID NO: 32999 - DNA, 201 bp, Homo sapiens
aaacccaatacatttatacttatgtatattcgtgtgtgtgtgtgtgtgtgtattatatgcatgtgtgtgtatttgtctgaaataaaagttttacaaaatgwtacttttatctgagcagtgtcctgctgttttttttcccctaggttgtgtttttgtgtttttgtttgtttgtttgtttctttgtttgtttttgagacagaa

SEQ ID NO: 33000 - DNA, 201 bp, Homo sapiens
cactatctaagttttttctgttaaaacccaatacatttatacttatgtatattcgtgtgtgtgtgtgtgtgtgtattatatgcatgtgtgtgtatttgtckgaaataaaagttttacaaaatgatacttttatctgagcagtgtcctgctgttttttttcccctaggttgtgtttttgtgtttttgtttgtttgtttgttt

SEQ ID NO: 33001 - DNA, 201 bp, Homo sapiens
atgttctatgttgctctaaaacagcatctctcaaacttttttggaccactatctaagttttttctgttaaaacccaatacatttatacttatgtatattcktgtgtgtgtgtgtgtgtgtattatatgcatgtgtgtgtatttgtctgaaataaaagttttacaaaatgatacttttatctgagcagtgtcctgctgtttt

SEQ ID NO: 33002 - DNA, 201 bp, Homo sapiens
tagcaggacaaattctgatggacagatcaagatgttctatgttgctctaaaacagcatctctcaaacttttttggaccactatctaagttttttctgttamaacccaatacatttatacttatgtatattcgtgtgtgtgtgtgtgtgtgtattatatgcatgtgtgtgtatttgtctgaaataaaagttttacaaaatga

SEQ ID NO: 33003 - DNA, 201 bp, Homo sapiens
gtttcccaaactttcaatgttttggatgactttggaagccttgatttctgtaggctgtagcaggacaaattctgatggacagatcaagatgttctatgttkctctaaaacagcatctctcaaacttttttggaccactatctaagttttttctgttaaaacccaatacatttatacttatgtatattcgtgtgtgtgtgtg

SEQ ID NO: 33004 - DNA, 201 bp, Homo sapiens
cagatctggatttcaccacacctggtttttgttgtcattgagtttttgtgatggggtgatttcagtgagaaatatatgccattaatttgatgaaaaatcartatttatttattaactaatacccaagaaattccccagcaagcctcttccagtattctagagtttctcgtttcttgaggattggtctccgggcatactcct

SEQ ID NO: 33005 - DNA, 201 bp, Homo sapiens
attatttctaccaagtccaacttgtagattgggcagatctggatttcaccacacctggtttttgttgtcattgagtttttgtgatggggtgatttcagtgrgaaatatatgccattaatttgatgaaaaatcagtatttatttattaactaatacccaagaaattccccagcaagcctcttccagtattctagagtttctc

SEQ ID NO: 33006 - DNA, 201 bp, Homo sapiens
tcaattatttctaccaagtccaacttgtagattgggcagatctggatttcaccacacctggtttttgttgtcattgagtttttgtgatggggtgatttcartgagaaatatatgccattaatttgatgaaaaatcagtatttatttattaactaatacccaagaaattccccagcaagcctcttccagtattctagagttt

SEQ ID NO: 33007 - DNA, 201 bp, Homo sapiens
atgccaagttttacagctttttgtatcatgagttttcttttgcatcaattatttctaccaagtccaacttgtagattgggcagatctggatttcaccacayctggtttttgttgtcattgagtttttgtgatggggtgatttcagtgagaaatatatgccattaatttgatgaaaaatcagtatttatttattaactaata

SEQ ID NO: 33008 - DNA, 201 bp, Homo sapiens
ggctaattattatgtttttaatagagactaggttttaccatgttggccaggctggtatcgaattcctgacctccatgtgatcggcctgccttggcctcccraagtgctgggattacaggcatgaaccactgtgcctagccttaataaatacgtatttatgtctttcgatctttttctgtttttctacattccgtttcccct

SEQ ID NO: 33009 - DNA, 201 bp, Homo sapiens
aaggacctaataaatacttttttctctctctctctttttttttttttttttttgagacggagtcttattctgttgcccaggctggagtgcagtggcggatsttggctcattgcaacctctgactcccaggttcaagggactctcttgcctcagcctcccgagtagctgggactgtaggcatgcactaccacacctggctaa

SEQ ID NO: 33010 - DNA, 201 bp, Homo sapiens
cagttcatcaaggacctaataaatacttttttctctctctctctttttttttttttttttttgagacggagtcttattctgttgcccaggctggagtgcartggcggatcttggctcattgcaacctctgactcccaggttcaagggactctcttgcctcagcctcccgagtagctgggactgtaggcatgcactaccaca

SEQ ID NO: 33011 - DNA, 201 bp, Homo sapiens
tatgcatgtgtgtgtacatgtaatcacagttcatcaaggacctaataaatacttttttctctctctctctttttttttttttttttttgagacggagtctyattctgttgcccaggctggagtgcagtggcggatcttggctcattgcaacctctgactcccaggttcaagggactctcttgcctcagcctcccgagtagc

SEQ ID NO: 33012 - DNA, 201 bp, Homo sapiens
agatttagattttttcaatttttttttactgtcatatgattcacatgctagttactgattgctatcatgcagtctgccagcagaccagatggcagatcttytaattagatatgtttgtgtgtgtatgcatgtgtgtgtacatgtaatcacagttcatcaaggacctaataaatacttttttctctctctctcttttttttt

SEQ ID NO: 33013 - DNA, 201 bp, Homo sapiens
gacatatttcttggattgtccgcactcataaaaagagattgcgtaacaccctttgaacaaatggatatttgagaaccatcctgtcttcagatttagatttkttcaatttttttttactgtcatatgattcacatgctagttactgattgctatcatgcagtctgccagcagaccagatggcagatcttttaattagatatg

SEQ ID NO: 33014 - DNA, 201 bp, Homo sapiens
gtgagtgcaataagtctgttttttgatcttagaacataacatttcttgttggctattgtgtgtgctatgtgtatgatttgtctctttgttaattctctatmaatataaaagagcaagtaatgaaattaccatggctgaattctgaatattaacccagagcagatttcctctaagaaagatcataagaagatgcttaaaaga

SEQ ID NO: 33015 - DNA, 201 bp, Homo sapiens
taaagccaaccatgttaaaaatgtataataaagtatctaatttagcaaaattcaaatttcccctatgaaatatcaagctctttttatgcttcttcacatgscaccttgtgtagaatttgaaccactttaaacattgcatccttgagttgcatatgatgggatctcttgaatcatttacattttgaaaaaagaaagtgaaat

SEQ ID NO: 33016 - DNA, 201 bp, Homo sapiens
ttcgcattacagattttaaatcctagctcctttttaagcttttaattccaacttgcatttcttattattctgtttacaaacctgacaaattttagcagtcrttttgaggagatctagaataatgtttcatctcatttttgaatttaggtacagaccttaaaaatattatgctacatttctaatattaatatcttgctttct

SEQ ID NO: 33017 - DNA, 201 bp, Homo sapiens
ctctcattacttgcccccaatccatgcaatgaaatactggcctgtgagtatgtggtcccttcagctcattttctgaagctgaccaaaggagcacagtaatkcataacgggggagtaaaattcctcaagacgagcaaaaaaggcagaaattaataaaactctatgtattagttatctatcactgcataacaagttacctcaa

SEQ ID NO: 33018 - DNA, 201 bp, Homo sapiens
tcttctttatattataagtttatgccactgcaacattttagaatcacctgggaagcttttgaaaactcccagcatcatgaagcatggtctcttgccttggrgtcagtgtctgtcaacgtggcttttgctaaagagccttcccctatgagaagtgaggcaggagaaggcggagtgaccacaagatgccctgatggtgccaag

SEQ ID NO: 33019 - DNA, 201 bp, Homo sapiens
tgaacatcgagtatagtaccaagtgtatacttttttttttttttttttttttttgaggtggaatctccttctgtctcccaggctggaatgcagtggcattwtctcggctcactgcagcctccgcctcccaagttcaagccattctccagtctcagcctcctcagtggctgggattacaggcatgtgctactacccccggca

SEQ ID NO: 33020 - DNA, 201 bp, Homo sapiens
tattaagagaatggatattttcatgtcagaaattataggaaggatacagttatgggatgaggagcaattcttttttttttttttttgaggtggagtctcaytctgtcaccaggctagagtgcagtggggcgatctcggctcactgcaaacctctgcctcccgggttcaagcaattctcctgcctcagactcccgagtagct

SEQ ID NO: 33021 - DNA, 201 bp, Homo sapiens
accatcatttattaagagaatggatattttcatgtcagaaattataggaaggatacagttatgggatgaggagcaattcttttttttttttttttgaggtsgagtctcactctgtcaccaggctagagtgcagtggggcgatctcggctcactgcaaacctctgcctcccgggttcaagcaattctcctgcctcagactcc

SEQ ID NO: 33022 - DNA, 201 bp, Homo sapiens
agaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtggagtctca

SEQ ID NO: 33023 - DNA, 201 bp, Homo sapiens
gcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcc

SEQ ID NO: 33024 - DNA, 201 bp, Homo sapiens
gcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacatgaacctgggaggtggaggttgcagtgagctgacatcgcatcactgcactccagcctgggtgacagagt

SEQ ID NO: 33025 - DNA, 201 bp, Homo sapiens
taatcccagcactttgggaggccgagccgggcgaatcacgaggtcaggagattgagaccatcctagctaacatggtgaaaccctgtctctaccaaaaatamaaaaaaattagccaggcgtggtggtggggcgcggtcgtgggtgcctgtagtcccagctactcaggaggctaaggcaggagaatggcgtgaacccgggagg

SEQ ID NO: 33026 - DNA, 201 bp, Homo sapiens
tcctgggaactgccctctactctctgcttctgtgagtttgactgctttaaattccacacaaaaagtgagatcatagagtatttgtctttctgcgcctggcwtattttacgataaattgattgcttctcttcccattgtttatagatacccattctcgtaatgatggcactgtgtctgtcatagaaggcctaattctccctg

SEQ ID NO: 33027 - DNA, 201 bp, Homo sapiens
tagatctccagaatgtattcattctgtctaactgaaacttaggatcctttgaccactatctccccatttatcaccccctcccacttccccactaccagccyctcctgggaactgccctctactctctgcttctgtgagtttgactgctttaaattccacacaaaaagtgagatcatagagtatttgtctttctgcgcctgg

SEQ ID NO: 33028 - DNA, 201 bp, Homo sapiens
caagctaattaacacatcggtcaacttacatagctatcattttttgtgtgtggcaagaacattgaaagtctagtctcagcaattttcaagtatataatacrttattattattactatcgttaactgtattcaccatgctgtacaatagatctccagaatgtattcattctgtctaactgaaacttaggatcctttgaccac

SEQ ID NO: 33029 - DNA, 201 bp, Homo sapiens
aggaaaaaaaaaattatatgtattcgtggtgtgaaatgtgatgttttgatattcatatgcattgtgaaatgactaccacaatcaagctaattaacacatcsgtcaacttacatagctatcattttttgtgtgtggcaagaacattgaaagtctagtctcagcaattttcaagtatataatacgttattattattactatcg

SEQ ID NO: 33030 - DNA, 201 bp, Homo sapiens
ctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgt

SEQ ID NO: 33031 - DNA, 201 bp, Homo sapiens
tacgtaaaagataaggcaaggagacctgctgagagtcacacagcaagcccccaaggtcccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccc

SEQ ID NO: 33032 - DNA, 201 bp, Homo sapiens
tccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagcggtgtgggtatgtttggagggaatgaatgtaaggagagagaggtgaggcacaggaga

SEQ ID NO: 33033 - DNA, 201 bp, Homo sapiens
gcacccagcctgtagtttcttatttaatgtctgtccccccttctcttgacagtggtgtttttgccttcacactactgtatccctggtccataccgtaaatkttctgtaaatgtttgtaaatgaatacatgaaagatgaccaggtgctgaatcagtgagagtccttaatgtacttcttatcatttatccctctgaggtaggc

SEQ ID NO: 33034 - DNA, 201 bp, Homo sapiens
agccactgcacccagcctgtagtttcttatttaatgtctgtccccccttctcttgacagtggtgtttttgccttcacactactgtatccctggtccatacmgtaaatgttctgtaaatgtttgtaaatgaatacatgaaagatgaccaggtgctgaatcagtgagagtccttaatgtacttcttatcatttatccctctga

SEQ ID NO: 33035 - DNA, 201 bp, Homo sapiens
acgggatttcaacatgttggccaagctcgtctcaaacctgcctcagcctcccaaagtgctgggattacagatgtgagccactgcacccagcctgtagtttsttatttaatgtctgtccccccttctcttgacagtggtgtttttgccttcacactactgtatccctggtccataccgtaaatgttctgtaaatgtttgtaa

SEQ ID NO: 33036 - DNA, 201 bp, Homo sapiens
agacgggatttcaacatgttggccaagctcgtctcaaacctgcctcagcctcccaaagtgctgggattacagatgtgagccactgcacccagcctgtagtktcttatttaatgtctgtccccccttctcttgacagtggtgtttttgccttcacactactgtatccctggtccataccgtaaatgttctgtaaatgtttgt

SEQ ID NO: 33037 - DNA, 201 bp, Homo sapiens
ctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtttct

SEQ ID NO: 33038 - DNA, 201 bp, Homo sapiens
gagacagagcattctgcttcagaactgtcctcctgagttgacttcccgtcagatcccactggttgggactgagtcatctgtttgtatcctagttataaagkagactagaaaagtgcataactggctttttgagcctctagagtggcaggcgaactctgattttgaggaaaaaggatagggtaatggtgttgacacaggcac

SEQ ID NO: 33039 - DNA, 201 bp, Homo sapiens
tggtatcgcaaatgcaacaaaaacaaataggtgggacttaattaaactaatcagcttttgcccagcaaaaggaacagtcagcagagtaaacagacaacccrcagagtgggagaaaatctatacaaatctatacgtctatacaaggactaatatccaggatctacatggaactcaaattagcaagaaaaaagctaacaatcc

SEQ ID NO: 33040 - DNA, 201 bp, Homo sapiens
ctgttcaccgcattcacgccaatatctattattttttgcatttttggtaatggccattcttgcaggagtaagatggtatcgcaaatgcaacaaaaacaaayaggtgggacttaattaaactaatcagcttttgcccagcaaaaggaacagtcagcagagtaaacagacaacccgcagagtgggagaaaatctatacaaatc

SEQ ID NO: 33041 - DNA, 201 bp, Homo sapiens
tgtttattttcttgactctagagcattcttttatgcagttaaattactctaaaatgttttgcacctgcacgcattaatgtgtattgtttggtaagaacttycgagttggtgaaaaaatgtattgtattttagtatctatatttatatatacatattagtctatgggttttaattcacaaaaccaggtgttgtatctggtgc

SEQ ID NO: 33042 - DNA, 201 bp, Homo sapiens
agtgtcgttctaaaaaagatgcaatatacttcaaatagctgcttctaaaatatgttaaaggaaactaacatttgctgagtactttctaataatgaagtcayatcatacgtgcattacatgtttattttcttgactctagagcattcttttatgcagttaaattactctaaaatgttttgcacctgcacgcattaatgtgta

SEQ ID NO: 33043 - DNA, 201 bp, Homo sapiens
atggtagttctacttttagttcttcaagaactctccacactgttttccatagtggttgtactagtttacattcccaccagcagtgtagaagtgttccctgytcaccgcattcacgccaatatctattattttttgcatttttggtaatggccattcttgcaggagtaagatggtatcgcaaatgcaacaaaaacaaatagg

SEQ ID NO: 33044 - DNA, 201 bp, Homo sapiens
gcccttttacagttacacatttctaattgttgctgtaaatgcattatcactttgaaattaattaatttttccattttggctgcctgcaatataataatcaytaatgagaaactcacaggaatcaattctcagcacagcggcccctactggtaaagccatgtctctgcctccctcttcttcttcagatccagagaactggac

SEQ ID NO: 33045 - DNA, 201 bp, Homo sapiens
agtatgtctttcatataaggacttcttttcctctgggaagatacccattagtgggattgctggatcaaatggtagttctacttttagttcttcaagaactytccacactgttttccatagtggttgtactagtttacattcccaccagcagtgtagaagtgttccctgttcaccgcattcacgccaatatctattattttt

SEQ ID NO: 33046 - DNA, 201 bp, Homo sapiens
gtacacactgctgtttaccttggcgaggcctttcaccaagtccatggtaagagaacagcttctggcgccgcaaacaccttgggtcctagagaaacctgcamacttgtgtctccacctttttacctcttgcgggcatgagtctggtctcagtaataacattgtccagcccatcataaagggctcttgaacacattttcatca

SEQ ID NO: 33047 - DNA, 201 bp, Homo sapiens
cagattcccgtgtacaggcatgccaccacacctggctaatttttgtatttttagtagagatggcattttgccatgttggccaggctggtcttgaactcccracctcaggtgatccactcgtctaagactcccaaagtgctcggattacagatgtgagccactgcacccagcattccttagatttccaataaaaataaaaag

SEQ ID NO: 33048 - DNA, 201 bp, Homo sapiens
tcctcccgcctcagcttcctaaagtgctgggattagaggcatgagccaccagacatgacctgtgtttatattgttaaatcaccattgtcaatcttgaaagkagactttgttttgatgtatgtaagattgagtttttactcatctctacatagtttcctcagattgcttttttttttttttgagaccgagtctagctctgtc

SEQ ID NO: 33049 - DNA, 201 bp, Homo sapiens
tttttttaatttttaaattttaaattcttacttttagatatgggggtctcactctgttgcccaggctagagttcagtggcacaatcatagctcactgcaaygttgacctcccaggctgaagcgatcctcctgcctcagccccccaagtagctgggaccacaggcatgtgccaaaatactcaactaattgtttattttttgt

SEQ ID NO: 33050 - DNA, 201 bp, Homo sapiens
tattgaagtctctctttgtagccaatccttttttttttttttaatttttaaattttaaattcttacttttagatatgggggtctcactctgttgcccaggstagagttcagtggcacaatcatagctcactgcaacgttgacctcccaggctgaagcgatcctcctgcctcagccccccaagtagctgggaccacaggcat

SEQ ID NO: 33051 - DNA, 201 bp, Homo sapiens
agagggtggggagagagttcagtatgtcaggactgctacatttatgagtgtgggtctttattgaagtctctctttgtagccaatccttttttttttttttwatttttaaattttaaattcttacttttagatatgggggtctcactctgttgcccaggctagagttcagtggcacaatcatagctcactgcaacgttgacc

SEQ ID NO: 33052 - DNA, 201 bp, Homo sapiens
tgatatctttctgtttccaaaagcagcagccctttattcaagacacttttctgtttaatttaattatctttgaacttcctgttgaaggttttgaaaaatayatgttagagggtggggagagagttcagtatgtcaggactgctacatttatgagtgtgggtctttattgaagtctctctttgtagccaatccttttttttt

SEQ ID NO: 33053 - DNA, 201 bp, Homo sapiens
tttacatttttcttttaaacgtataagactattgatggtacctcaccaaggttataacccctttataatcattaatttttaatctagaaaagagtcttggrgacaacaagactcatctataatttcttggatgctcaaatgaaaatatacaggactcaagcattagctaaaataatccaggaaagccctgtcaaaggttag

SEQ ID NO: 33054 - DNA, 201 bp, Homo sapiens
ggattcccattatgcttcttcattacccggtgcccagaatgaacttatagaagcagaatatgaggggtcctttgacaaacatgagactgtttagaaaattscttttgtttgctgtgatccattttgtaagggaagtcactataatgttgttatttaagagaaagagacaaacggaaagaaacaaacagctggtgtttaacg

SEQ ID NO: 33055 - DNA, 201 bp, Homo sapiens
cttccacccaaaaaatcaccatgatatccagctgtggaagagttcattatggagagcttcctggaagaagtagtccctgaactgggttgggctaaacaaayatgccaagaagggtttctggaagcagttgacaaaagatgagtagagagagggagggggtggtgctatatttattccatacctttcagatactctctaaat

SEQ ID NO: 33056 - DNA, 201 bp, Homo sapiens
agtgagccttttcaccaatcttggaaggccagtaatgtcagtgaacactaggaatggtgtcatggcctgggtcctgaagagtggatacttaatgtccatgraggcatgcatttttatctgccttgcatggcttctttcattctctccctgacttccacccaaaaaatcaccatgatatccagctgtggaagagttcattat

SEQ ID NO: 33057 - DNA, 201 bp, Homo sapiens
ggcacagtgagccttttcaccaatcttggaaggccagtaatgtcagtgaacactaggaatggtgtcatggcctgggtcctgaagagtggatacttaatgtmcatggaggcatgcatttttatctgccttgcatggcttctttcattctctccctgacttccacccaaaaaatcaccatgatatccagctgtggaagagttc

SEQ ID NO: 33058 - DNA, 201 bp, Homo sapiens
agctgagatttaggctgcacctgagtaccaggcagggtcctaagtgacttcagactctatagacagtccctgacttataatggtttgacttagattttttsacctttgggatgctgagaaaaccatacacatccagtagaaaccgaactttacattttgagtttcgatttttttttttcacctgggctagtaatacgtggt

SEQ ID NO: 33059 - DNA, 201 bp, Homo sapiens
tcatattggttacagtgatagcagctgagatttaggctgcacctgagtaccaggcagggtcctaagtgacttcagactctatagacagtccctgacttatratggtttgacttagattttttcacctttgggatgctgagaaaaccatacacatccagtagaaaccgaactttacattttgagtttcgatttttttttttc

SEQ ID NO: 33060 - DNA, 201 bp, Homo sapiens
gccttcctgtctttgccacatcacgggattttctacagctcatattggttacagtgatagcagctgagatttaggctgcacctgagtaccaggcagggtcytaagtgacttcagactctatagacagtccctgacttataatggtttgacttagattttttcacctttgggatgctgagaaaaccatacacatccagtaga

SEQ ID NO: 33061 - DNA, 201 bp, Homo sapiens
aaatctgaatggcatgacctttattgatttgtaattcaacaacttcaacatcttaccaagaagaatgtgcagttattctagcaggagaaacaatgcaattrgagcctgcgagatgaaatcaaattgttttataatgagaaattagggaattcgaggcagacattagctgtgtaattgtggaaagggaagaactgtagttag

SEQ ID NO: 33062 - DNA, 201 bp, Homo sapiens
aaggcagaagcagcctccactgagaagcgtcagacaccacgtcagtcttgctttccattgctttgctccagtatccatttgaaattcagtgcaaacccatraattccactttgcctctggtagcagcctgcatggtgtgtatattgaacactagaaacacagtaaatccagcccatttattcacattaaccagcaaaggca

SEQ ID NO: 33063 - DNA, 201 bp, Homo sapiens
ggccgaggcaggtggatcggttgaggtcagagttcaagaccagcctggccaacatggtgaaaccctgtttctactaaaaatataaaaattacctaggcgtsgtagtgtgtgcatataatcccagctactctgtaggctgaggcaggaggcagaggttgcggtgagctgagatcgcactacttcattccagcctgggcaaca

SEQ ID NO: 33064 - DNA, 201 bp, Homo sapiens
ctttcccatgctattctcataatagtgaataagtctcatgagatctgatgggtgtatcaggagtttccgcttttgcttcttcctcattttctcttgccacygccatgtaagaagtgccttttgcctaccaccatgtttctgaggcctccccagccatgtggaactgtaagtccagttaaacctctttttcttcccagtctc

SEQ ID NO: 33065 - DNA, 201 bp, Homo sapiens
tgttgtgggagggacccagggggaggtaattgaatcatggggcccagcctttcccatgctattctcataatagtgaataagtctcatgagatctgatgggygtatcaggagtttccgcttttgcttcttcctcattttctcttgccactgccatgtaagaagtgccttttgcctaccaccatgtttctgaggcctccccag

SEQ ID NO: 33066 - DNA, 201 bp, Homo sapiens
tgctttagaaaacatctggctgggcatggtggttcacacctgtaatctccacactttgggaggctgaagtaggctgaagtgggaggatggttagagcctakgagttcgagaccagtctgggcaacaacgtgagatcctgtctctacaaaaaataaaaaaaattatctgggtatagtggtgtgcacctgaagtcccagctaa

SEQ ID NO: 33067 - DNA, 201 bp, Homo sapiens
tgttcaagactgccctgggcagcacagtgagaccccgtatctacaaaaaataaacaaacttagccaggtgcggaggcattcacctgtattcctagctactyaggaagctgagatgggaggattgcttgggccctggacgtcaaggctgcagtgggccatgatcgtgacactgtactgcagcctgggcgacagaatgagacc

SEQ ID NO: 33068 - DNA, 201 bp, Homo sapiens
gccggatatagtgcacatggtgaacacataaataatgtttgttggccaggcgtggtggctcatgcctgtaaccccagcactctggaaggctgagtcagaasgattgcttgagctgaattgttcaagactgccctgggcagcacagtgagaccccgtatctacaaaaaataaacaaacttagccaggtgcggaggcattcac

SEQ ID NO: 33069 - DNA, 201 bp, Homo sapiens
tcccttccaccatgattgtaagtttcctgagacctccacagccatgccaaattgtgagtcagttaaatctctttgctgtataaattacccaggcttgcatrtgtctttattagtggcatgagaacagactaatacagtcagggatgctgcagaacatctccaaacacacaggactcccaccctctacttccaccccaccaa

SEQ ID NO: 33070 - DNA, 201 bp, Homo sapiens
ttcccttccaccatgattgtaagtttcctgagacctccacagccatgccaaattgtgagtcagttaaatctctttgctgtataaattacccaggcttgcakatgtctttattagtggcatgagaacagactaatacagtcagggatgctgcagaacatctccaaacacacaggactcccaccctctacttccaccccacca

SEQ ID NO: 33071 - DNA, 201 bp, Homo sapiens
tgcttctctaccggggcaaattttcccccaagggataattgataatgtctgaggcatttttaattgtcacaacttggggaaggggcaagggattgagggakagtgctcctggcatctggtgggtaggggttagtgatagggttcggctgtgtccccacccaaatctcatcttgagttgtagttctcataatccccacgtgt

SEQ ID NO: 33072 - DNA, 201 bp, Homo sapiens
tgacaaatcctactttttcaggtcctgatgcactaagtctcattcacttctttctatttttcctctctctattgcatattaacccaccatattgagagaayagaaacttttgccttcattatatcacctttacaccccaggacaggtgccctcctcagcggagacaactgtccccctccatcctgcaggagttttgcagcc

SEQ ID NO: 33073 - DNA, 201 bp, Homo sapiens
aattcacgagatcattcatgatgagtcactatatcagttactttaaaaaaaaaaaaaaagatcctgacaaatcctactttttcaggtcctgatgcactaastctcattcacttctttctatttttcctctctctattgcatattaacccaccatattgagagaatagaaacttttgccttcattatatcacctttacaccc

SEQ ID NO: 33074 - DNA, 201 bp, Homo sapiens
ccaccctcagccagggcaggagtattccctaatggtagagtcaagtgtttggtttggtcttgtttctaatgactcaagtgatgaggcctggggacgtcccytgggaagctattctgcagcctaataactttcattctgtgatttttttttgtatgtgtctaatattcagagtctgacacaataaggccataaagagctaag

SEQ ID NO: 33075 - DNA, 201 bp, Homo sapiens
tcctcaggattattttttctctgtgctgttcactgtaacatcgtccaccctctgagatcttgcttttcagtctactggtatctccacttctctctgcagcrtgatgtctagtcagagtttccattctgtttttatgaccctgggaggactgggacagatctgtgaggtcatcttgtccaccctcagccagggcaggagtat

SEQ ID NO: 33076 - DNA, 201 bp, Homo sapiens
taggaacactcatagtatgtatcagaaactagtgaacacatgttgttttacagctctgtctgcaaaattgcatcgtgggcctctttggggagtgttctcartgtgatttttattctggggtgtcctttggccacaatcctcaggattattttttctctgtgctgttcactgtaacatcgtccaccctctgagatcttgctt

SEQ ID NO: 33077 - DNA, 201 bp, Homo sapiens
gatttattcattcttctccctcacaattttggctcgcacatgcttcctttttagctcatgaccgtgcaattcaactcaacctcatggcatctttttatcarctgtccctgctgcaacaggcttagagttggtttcccaattccctagcgcagaaatccactggcatgagtcatctttcccattggtagattgcagagcaaa

SEQ ID NO: 33078 - DNA, 201 bp, Homo sapiens
atacccccgacttcctttcctacgaataaagaggcccaactttttgtccatatgaagaggttggcagagcaaacgcacacgtgcgtaggagctggaattgkcgataatgtcacaatctcaggaaacccaactttgtaaatgtgactttcctttgctactttttgcctattaagcagccatgtatgtaaagtattaaattag

SEQ ID NO: 33079 - DNA, 201 bp, Homo sapiens
acgagctgccacgcctcacctcttgttttcaataccattgataagttgtggtcttcagggacttgtgggcattttcaagttaaatatccaacagtcgtgayttagggcatgaagagctcactcatcaagatgtatgtaattcagattttctgagtgtttaattcggcgtctttggtcacaaggaacagagttttacttgtg

SEQ ID NO: 33080 - DNA, 201 bp, Homo sapiens
aagtctcgctttgttgcctaggctggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacagtcgtgatttagggcatg

SEQ ID NO: 33081 - DNA, 201 bp, Homo sapiens
aaaggtatttctccccttcacggtaatttggagccaatacttcttgcaccattcatttgtccacagcatgggacaaaggataatgccttaatgcctgctgmaaatagaacagtggtgcttagcagctttagataatgcattgtaggtgttttgcaaaaacatactttcgtgactaaacatcataagctccaagtgagtgat

SEQ ID NO: 33082 - DNA, 201 bp, Homo sapiens
agcaagatcccaaccctattaaaaaattaaaaatgaaaataaaattttaaagaaaggtatttctccccttcacggtaatttggagccaatacttcttgcamcattcatttgtccacagcatgggacaaaggataatgccttaatgcctgctgcaaatagaacagtggtgcttagcagctttagataatgcattgtaggtgt

SEQ ID NO: 33083 - DNA, 201 bp, Homo sapiens
aatagtttaagtagagccactgaaagatggctcacacctttcagctcagtttttttgtaccagtgaggatgaatgtttctgcatgtgggtagttggcaccrgtcttcaatgaattatttttcctttagccgggtctggtggtggcgtgtacctgtaatcccagctacacagaaggctgaggcaggaggataccacgagccc

SEQ ID NO: 33084 - DNA, 201 bp, Homo sapiens
tctatttaaactagtaaacttaatagtttaaaatacttggtagtttaatagtttaagtagagccactgaaagatggctcacacctttcagctcagtttttwtgtaccagtgaggatgaatgtttctgcatgtgggtagttggcaccagtcttcaatgaattatttttcctttagccgggtctggtggtggcgtgtacctgt

SEQ ID NO: 33085 - DNA, 201 bp, Homo sapiens
tcttctatttaaactagtaaacttaatagtttaaaatacttggtagtttaatagtttaagtagagccactgaaagatggctcacacctttcagctcagttkttttgtaccagtgaggatgaatgtttctgcatgtgggtagttggcaccagtcttcaatgaattatttttcctttagccgggtctggtggtggcgtgtacc

SEQ ID NO: 33086 - DNA, 201 bp, Homo sapiens
actttggaggctgaggcaggagaatcacttgaacccgagaggcggagattgcattgagccgagatcatgccacagcctgggcaacagagcaagactgtctsataaataaataaataaataagctggacgtggtggcatgtgcctatggtcccagctacttgggaggctgaggtgggaggatggcttgagcccagaggtaga

SEQ ID NO: 33087 - DNA, 201 bp, Homo sapiens
taaagcatttgggcactgcctggcacataggatatgtccagaaaacactagctggtattaaaacagaggaaacatgggaactgagggtggtcagtgacatsacattgtatttcctttatggtgtccttctgagtacagaaccaaacatttcttaggcgtacaatttcctgcctccaaattaatgttatttctaaaaagtag

SEQ ID NO: 33088 - DNA, 201 bp, Homo sapiens
gttctgtggtcagttactcattagcagcctctgctctaggaggaatagttatgggtcctttcagacatgcaacccccaaaactccatgttgtttacagtgygggacacctgactttcaccttttatgatacctgcctggggcatgcatgtggtgactttttccatctctggtctctatcttatctcttgtgatgaactcag

SEQ ID NO: 33089 - DNA, 201 bp, Homo sapiens
cttgtgatggtttagcttatttagtacaacaaccctgccccttctagtttttatgataacctcattaattgccggtactctcagagccctgattttcttayctataaagtagagattccctatctcatttggaggtgattttaaggcacaaatgagacagtgtatgtaaagcatttggcatagtgcctgattcagagtaag

SEQ ID NO: 33090 - DNA, 201 bp, Homo sapiens
gcctgcagacactcagatttcaaacctctggcttcctgaactgtgaaagaataaattgctgttgggccaggtacagtggctcatgcctgtaatcccagcastttgggaggctgaggcaggtggatcacttcaacccaggagttcgagaccagcctgggcaacaaggcgagaccccgtctctacaaaaaataccaaaaaatg

SEQ ID NO: 33091 - DNA, 201 bp, Homo sapiens
agagatgtgaatgtgatcgtactggtttagggtgggccctacatccaataagaatgtccttagcagagacagaacagagacaccgagagaggaaggtgatkccaagacagaagtaaagattggagtggtgccatctaccagccaaggaatgccaaggctgtggctacaccagaagctggaacagagcctgcaagcatttct

SEQ ID NO: 33092 - DNA, 201 bp, Homo sapiens
ccactttctggctattatgaataatactgcgatatgaacatctggttacttctggctcttatgggtaacacttctataagcgttgccacaggttgcttctratttctattatgagtaatgctgctatgaacattcatatacaagttttagggcagacttctattttcattccaatatctctttatggcatgtcttagcagt

SEQ ID NO: 33093 - DNA, 201 bp, Homo sapiens
tttttaaaaaacataaaacaacatacattcatcattttgctttctttggatgaagaattgagcctggttcagcatctcttgcaggctgtaattgagggtgrtcattgactggggctggattcgggaaggatccacttccaagctgcacagttgttggcaagatgtagtgttttggtggttcctgggctctgggactcagct

SEQ ID NO: 33094 - DNA, 201 bp, Homo sapiens
ttcaagaaaacctcactgagcacctaccatgtaggtgctcatcccgataccactatcaggccctttggaccagttgcaaggatgcaggatgaggaaggcartgtgagaaaacagaaggagcaccaggcagtcgtgggcttgatttttattttactattttttaaaaaacataaaacaacatacattcatcattttgctttc

SEQ ID NO: 33095 - DNA, 201 bp, Homo sapiens
atgtggagaaaacagtattggaaattattactcagttcaagaaaacctcactgagcacctaccatgtaggtgctcatcccgataccactatcaggcccttkggaccagttgcaaggatgcaggatgaggaaggcaatgtgagaaaacagaaggagcaccaggcagtcgtgggcttgatttttattttactattttttaaaa

SEQ ID NO: 33096 - DNA, 201 bp, Homo sapiens
agttgcagatatggatagccttttcaaaaaatgcatgcaactgagactattggctatgttttgtttattacctactttttccatttaatagtatcttggasattatttggtaccagcacatgtagctcaacctcctaatactgcatgacggataatatgccatcacatggtgtcatttaatatattcattcctatttatag

SEQ ID NO: 33097 - DNA, 201 bp, Homo sapiens
gagaacttctgatcaaaaatgccagataagaaaaaaaaacctttcgagacatcatttgaatcaattatcaaatgtttccaaagtgcacttgctttgcaaascactgtactactcatctctgcctccatcggagcgagttcaggagagttgtgtttacttttctaaaggagccttttccttcccattttaccagtgcccaaa

SEQ ID NO: 33098 - DNA, 201 bp, Homo sapiens
gtgcatcttaaaatccacaatgcacagcctggggagaagccttggttttgccagggggaaaaaaagaaaaacacaacattgagtgaggtctagggtgaatrccaaaggtctgttttgaaatgggggtgtgggttattcttctctctttctgatttgcttcagtacagtatgggatggggaagaatcaaaattattatgtca

SEQ ID NO: 33099 - DNA, 201 bp, Homo sapiens
accccagctctgtattcgagcgtggttatctttgtgcatcttaaaatccacaatgcacagcctggggagaagccttggttttgccagggggaaaaaaagaraaacacaacattgagtgaggtctagggtgaatgccaaaggtctgttttgaaatgggggtgtgggttattcttctctctttctgatttgcttcagtacagt

SEQ ID NO: 33100 - DNA, 201 bp, Homo sapiens
tatttattgagacactaatatatgccaggaattattctattggttcctttggaggagacatgaataaaggcatggatgtgactgaggaggtaaaggtgaasaattggggaggggtggatggggctgactcatgacctaaagaacatggcatctggggctctcttgaaataatctgcactaaccactcattcacattttttt

SEQ ID NO: 33101 - DNA, 201 bp, Homo sapiens
cttgaacccgggaggtggaggttgcagcgagtcaaggtcacgccagtgtactccagcctcggtgacagagcgagactccgtctcaaaaaaaaaaaaaaaargaaaaagaaaaagaaaaaggtgtttggaagccatgtcccatgaattccaaatacaattgaggactctataaaggactataaaaaaagttgtaataaatta

SEQ ID NO: 33102 - DNA, 201 bp, Homo sapiens
caggattttgaggctaccctgagctatgatcacaccacagcactccagcctggccaacatagtgagacactacctagatagcttaggagagttccaatgtktctgaaggatgtttttttaaaagaagtattcatttaggtgacacatatttattgagacactaatatatgccaggaattattctattggttcctttggagg

SEQ ID NO: 33103 - DNA, 201 bp, Homo sapiens
atatggtgaaacctgtcactactaaaaatccaaaaattagctgggcgtggtggtgagcacctgtaatcccagctactcgggagcctgaggcaggagaatcrcttgaacccgggaggtggaggttgcagcgagtcaaggtcacgccagtgtactccagcctcggtgacagagcgagactccgtctcaaaaaaaaaaaaaaaa

SEQ ID NO: 33104 - DNA, 201 bp, Homo sapiens
aatatggtgaaacctgtcactactaaaaatccaaaaattagctgggcgtggtggtgagcacctgtaatcccagctactcgggagcctgaggcaggagaatyacttgaacccgggaggtggaggttgcagcgagtcaaggtcacgccagtgtactccagcctcggtgacagagcgagactccgtctcaaaaaaaaaaaaaaa

SEQ ID NO: 33105 - DNA, 201 bp, Homo sapiens
cctggccaatatggtgaaacctgtcactactaaaaatccaaaaattagctgggcgtggtggtgagcacctgtaatcccagctactcgggagcctgaggcargagaatcacttgaacccgggaggtggaggttgcagcgagtcaaggtcacgccagtgtactccagcctcggtgacagagcgagactccgtctcaaaaaaaa

SEQ ID NO: 33106 - DNA, 201 bp, Homo sapiens
cgagaccatcctggccaatatggtgaaacctgtcactactaaaaatccaaaaattagctgggcgtggtggtgagcacctgtaatcccagctactcgggagmctgaggcaggagaatcacttgaacccgggaggtggaggttgcagcgagtcaaggtcacgccagtgtactccagcctcggtgacagagcgagactccgtct

SEQ ID NO: 33107 - DNA, 201 bp, Homo sapiens
atcgagaccatcctggccaatatggtgaaacctgtcactactaaaaatccaaaaattagctgggcgtggtggtgagcacctgtaatcccagctactcgggwgcctgaggcaggagaatcacttgaacccgggaggtggaggttgcagcgagtcaaggtcacgccagtgtactccagcctcggtgacagagcgagactccgt

SEQ ID NO: 33108 - DNA, 201 bp, Homo sapiens
tgggcagatcacgaggtcaagagatcgagaccatcctggccaatatggtgaaacctgtcactactaaaaatccaaaaattagctgggcgtggtggtgagcmcctgtaatcccagctactcgggagcctgaggcaggagaatcacttgaacccgggaggtggaggttgcagcgagtcaaggtcacgccagtgtactccagcc

SEQ ID NO: 33109 - DNA, 201 bp, Homo sapiens
ctcaagcgatcttcccacctctgccacttgaatagctgggactacaggtgggtaccaccatacccagctgttgaaaaaaaaatggtggggtattactctgktgcccaggctggtgttgaactcctggcctcaagcgatcctcctgcctcggcctcccaaagtgctgggattacaggcttgagctacttccccaggctcttc

SEQ ID NO: 33110 - DNA, 201 bp, Homo sapiens
gatcttggctcactgcaaactccacctcccaggttcaagggattctcctgcctcagtctcccaagtagctgagattacaggcgcccaccaccaagcccagstaatttttttggttttttttgtattttagtagagacgggatttcaccatgttggccaggctggtctcaaactctggacctcaaatgatccaaccgcctcg

SEQ ID NO: 33111 - DNA, 201 bp, Homo sapiens
gttctttaaattcttctctaaaccccaaggctaagcaatatacaatctagttacaatggtctgcttgctgttaccagaatctatcaagctctttcctatckaagggttttttccatgtactggtttctctcctgcgtggtcttgttctacccttgaggagggtaccacttcctcattgcttagttgtcagtataaatgctc

SEQ ID NO: 33112 - DNA, 201 bp, Homo sapiens
tcatgtttattatcttattttcagtttcaaaagggcatatcctgccccctttcccaagatcagaggataaggaatgtcttgatgttctcagtcgtaaaatyaggctaataacacctcccatggttgtctgtgaggacaacagaaagtaatgttttctctgaaaagtttaaaagggtaaatggcttcatcacatggtgatga

SEQ ID NO: 33113 - DNA, 201 bp, Homo sapiens
tgaggcaggagaatcatttgaacccaggaggcggaggttgcagtgagccaagattgcgccactgcactccagcctgggtgacagagcaagactctgtgttwaaaaaaaaaaaaaaaaagttctaaatcagtggattctgccgataaacatcatctggacggaatgaagctgagggccaatagtttagaggctcagcacccg

SEQ ID NO: 33114 - DNA, 201 bp, Homo sapiens
aaggtgttgatagaaccccttagtgtcctcctcataccacagacactctcttcccccacttacttggccaatttttttttttttttttttttttttttggkggagtctcgttctgtctcccaggctggagtgcaatggtgcgatctcagctccctgcaacctctgcctcccatattcaagggattctcctgcctcagcctc

SEQ ID NO: 33115 - DNA, 201 bp, Homo sapiens
gctgctgttggctcctgtgttcttgtgatgtacacacatcatggtgtggtgtgtttttatctttggttttgttttcacttcttttttgctttttgtgcctyctcttccctcttccccccacctcatacatacacaaagggcagcatgctactataatttctggaatctcagccatattcttcttttttttgttttaaataa

SEQ ID NO: 33116 - DNA, 201 bp, Homo sapiens
ctcttcgagggtagagtatctgcataaactacttggaattctacatggaatatttgtgtcttctcccccatttatttatttaatcatttatttatatcacrgtacactcatggacatttattttatgctttatgttataatcctatactactttatttattttgttgcttaaatttttccagatggaacaatttggtcttc

SEQ ID NO: 33117 - DNA, 201 bp, Homo sapiens
gtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgc

SEQ ID NO: 33118 - DNA, 201 bp, Homo sapiens
cgtattcagcaaccaaaattttatcacttgcctgatactgcctggtgagcaggtggaaatgtagacacccaaacacccttcatggattcccagctgctgasagtttgaatagtatgtgaagtctgtagagacaaaattgttgttttccccagttgtaaagtgtgcaatattatccttgcaaaattgtctgtttattttttt

SEQ ID NO: 33119 - DNA, 201 bp, Homo sapiens
aaaatgctaacccatatgggagaaatttccaaagaattaaaaccacccaccaggaaaatgggaaagtctcccctccacacacacacacacgcgcgcgcgcrcacacacacacacacacacacacacacacaaaatcaccaaatcacacctgaacaagaggaagaaaattaaactcattgaggagataccatcttttttaaa

SEQ ID NO: 33120 - DNA, 201 bp, Homo sapiens
aatctcagttccttttattagaaaaaaaaaaaaaaacaactcccctggagcctttgtaccttctgcagtttggggttgttgtcctttttgcttggtgcacrggaatacttggtgatgttctttttaaaactgccctcacattgtatcctggaaagttcatttacctgtacccggagttggaacttctcttccacatctttt

SEQ ID NO: 33121 - DNA, 201 bp, Homo sapiens
agacaggtggaagttgatgctaaagattggcgttaaattgagtaaaccattcatgtagtaaataagataatttgtttctgccccccaaaagattaaaatayagatttttttcaaagtctgtttttttaacacctacggtccctgaatatgttcgattgaggtttgtgtctgtaatttggaacggctttttgttgcaactaa

SEQ ID NO: 33122 - DNA, 201 bp, Homo sapiens
ttatttaaaactcaagcccctctcatcctaacgtggtggcctttcattcattttacaggaacagtttagttttgggggaaagctgttatttaaactataawcgaaatttctcccaaagttagcttggcccatgcccaggaatgaccaaagacagctaaccagttaccggaaacgggtcccaatctagaccccaagagagag

SEQ ID NO: 33123 - DNA, 201 bp, Homo sapiens
cggttctgatttattaaccatttacttggctttggagaaggcagcatttttagtagtactgttgagcctgcatgtagcttttccaggagggcagggtgccyggatatctgatcttacagttattactttgtgtcatatataattttgttttctccctgcaacaaataaatctttgggactccggaagaaaaaaaaatggga

SEQ ID NO: 33124 - DNA, 201 bp, Homo sapiens
ggagaagacagtgtctgctgatgtgcttaacttttttttttttttggtcaggtgtgtaggtatgtgactgaaacccatagactttgcacatattgtcaaawgactttccagagggactcaggcactttatttaattaatgccaatgaagcccgttaatccgctcattactgcagtttaattttgatgctggtttttgatga

SEQ ID NO: 33125 - DNA, 201 bp, Homo sapiens
caataaactttattttcttcataagaattcagtctacgcaagggtattaggcagcttgtttgcaccttttaattgctggatgttttccagaaaggctgttwgcagtagttccagtgggttcatctgtgaatcaggaaagacaatgcagctttgtgttttggtttttatcagttaccttctgtttgtaaacatctgtttgga

SEQ ID NO: 33126 - DNA, 201 bp, Homo sapiens; identical to SEQ ID NO: 8755

SEQ ID NO: 33127 - DNA, 151 bp, Homo sapiens
cttccacttacctatctttaggcttctttataaaatgttcatttaatctgatctctataagaaattctgtatccttaaacaacatgtgcctttctctttasacagagcgattacccccttgctatgttttattagcagctagcaagtgctg

SEQ ID NO: 33128 - DNA, 161 bp, Homo sapiens
ctatgacaggcttccacttacctatctttaggcttctttataaaatgttcatttaatctgatctctataagaaattctgtatccttaaacaacatgtgccyttctctttagacagagcgattacccccttgctatgttttattagcagctagcaagtgctg

SEQ ID NO: 33129 - DNA, 201 bp, Homo sapiens
atactcataaatatgcattcatattttgtgtatgagtacacttgttaatttacatgtatgtcttgatttatatacattgttctatacctttccttttcccrtaattttatggattacatttattttcatttctgtatatttagttaattcttttaaaaggctgcctgttatcccattgtctgtcttcaccatcatttactt

SEQ ID NO: 33130 - DNA, 201 bp, Homo sapiens
ttgtaagtttgcctaatttcaatactgttgtgtctcaggtaatagggaggcccaaggagggggaaagagaaggagaacagcaggttgctggagccagtgtkgtattcataaatataacatttatcaattaagtttgccatctgatatgggtgcagtttgtggtgccccaaaaaatgacaatggggacatcaaagatcactg

SEQ ID NO: 33131 - DNA, 201 bp, Homo sapiens
tggctttctcgttaagcttaatcacttctagcttttgatttaaagtgagagacatgcaactctgactttctcttgggcactgaaaagccattgaagggttrtaagtttgcctaatttcaatactgttgtgtctcaggtaatagggaggcccaaggagggggaaagagaaggagaacagcaggttgctggagccagtgtggt

SEQ ID NO: 33132 - DNA, 201 bp, Homo sapiens
ccctcatcatcaacccctccccagctaccctgcaaaagagtcacagatcattgggataactagaaccacagagatccccctagacttgtcagccagggaamctgacactcttagaccttcttctgagtgctttgtccttgtccggagagctcggggaggagcaaggttgtactgggatttttttccgatcacagaaagtaa

SEQ ID NO: 33133 - DNA, 201 bp, Homo sapiens
tttcataggcaatatgtctgataattgcagagagatactgagttaacttgtagcaatgagtttctgtgacaaagggaaatcagtttgtttgcagtaagccraggataacggcgccgaaactttactatttgggggtggggggaggttggggaagggaggccctgaaattgctttttataattaaaaagggaatctcagatg

SEQ ID NO: 33134 - DNA, 201 bp, Homo sapiens
ggtaacttgttttcactccctcagaacctcagtttcctttcctatacaacgcaagccataaggttaacccctcctcgtggtgatgttaagatgaaacaggraggtgaggggcttaacacatttccgtgttcccataagctttcaggagatcttggtagttttcatctcggtcttcattaccatcatcactgcttcagactc

SEQ ID NO: 33135 - DNA, 201 bp, Homo sapiens
ttgcaccactgcactccagactgggagacacagcaagaccttgtctcaaaaaaaaaaaaaaagccagattctccacctaccagtggtggggccccttgggyaacttgttttcactccctcagaacctcagtttcctttcctatacaacgcaagccataaggttaacccctcctcgtggtgatgttaagatgaaacaggaag

SEQ ID NO: 33136 - DNA, 201 bp, Homo sapiens
tctcctttacggccaggtctccttcgtcctccctgctcagaatttcagtctttttttttttttttccctatacagacacaggaagtatatattttcctctygaatatcacttgggtcttatcttgttttatgctacatgcatgtggcttcccccgttacaaaaagaattcacattattagagaacatttggaaaacataca

SEQ ID NO: 33137 - DNA, 201 bp, Homo sapiens
accaagtatgaattctcatatgttcttaaagtatctgctgatttcttcaaacatctctaacaacatgtctgatgaatacgaagcctccctttatttatttwttttctttttgctttctttttttgggggcagggggcacagtttttctttctgtctcagtctctcaaactgtaggaggaccaacttcagggttttattttg

SEQ ID NO: 33138 - DNA, 201 bp, Homo sapiens
aaaataaaagaacctgaagccgccaagagaggctcactgaccatctctgggggaggaagggtgaagagtagcaaatttaccgtcatcagcaggtgtgtaawtgttccatttacattgaatggcacatgtcataaagtacataccgctgcacatcccaccctctgtttctgtttcaactgcagagcctatttttctttccct

SEQ ID NO: 33139 - DNA, 201 bp, Homo sapiens
aaaaataaaagaacctgaagccgccaagagaggctcactgaccatctctgggggaggaagggtgaagagtagcaaatttaccgtcatcagcaggtgtgtaratgttccatttacattgaatggcacatgtcataaagtacataccgctgcacatcccaccctctgtttctgtttcaactgcagagcctatttttctttccc

SEQ ID NO: 33140 - DNA, 201 bp, Homo sapiens
ggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtcattcagatttagcttgggagagtctagtgggtgttagg

SEQ ID NO: 33141 - DNA, 201 bp, Homo sapiens
accacaagtatgcaccaacatgcctggttaatttttgtggttttttttttttttttttttttcctgctgagatggggatttcaccatgttctccaggctgktttcaaactcctgagtccaggtgatccacccatcttggcctcccagagtgctgggattacaggtgtgagccactatgcccaataccccctatgtagactt

SEQ ID NO: 33142 - DNA, 201 bp, Homo sapiens
ttcatttcaaaataagttgtaggtcaggtgcagtggctcacacctgtaataccagcattttgagaggcagaggtgagaggattccttgagtccgggagttsaagaccagtctgggcaacatagtgaggccttatctcttcaaaaataaaaaaaattagctgcccatggtggtgtatgcctgtggtcccagctacttgggca

SEQ ID NO: 33143 - DNA, 201 bp, Homo sapiens
ttagcagctttttctacaaatctcttggcgggtggggggatatttcactcttctatgaatcaaataatatatggctttttcctattggaaaaaattagtcktgtgaactttattcttcaagaaaaagtagtttttatctgccttggaaatgtcaaaaggattcacgagtttcacaagtgatgatctgggttgattgctagg

SEQ ID NO: 33144 - DNA, 201 bp, Homo sapiens
ctacaaaaatattagtcaggcatagtggcgtatgcctgtagtcctagttactcgggaggctgaagcaggaggatcacctgagcccagggaggtcaaggctrcagtgagctgtgattaggtccctgcactccagcttgggtgacagagtgagaccctgtctccaaaaaaaaaaaaaaaaaaaacaaaagaccatttttaaga

SEQ ID NO: 33145 - DNA, 201 bp, Homo sapiens
ataagacatttccagtgtctagtccaaattagtatttctctaattctcgagtgtctgatctgcctggctagaatgattaaaacaaaaaaatagcaaatcaktttgacagtccacttcattaagtggaggacagtgttttgattgctatttaatctgtttttccttctgtctgttcttggctatatggaattcactttgcct

SEQ ID NO: 33146 - DNA, 201 bp, Homo sapiens
gcagccatcttgctttgtaagccttctctagctttatgatgctcccagtatataagacatttccagtgtctagtccaaattagtatttctctaattctcgmgtgtctgatctgcctggctagaatgattaaaacaaaaaaatagcaaatcagtttgacagtccacttcattaagtggaggacagtgttttgattgctattt

SEQ ID NO: 33147 - DNA, 201 bp, Homo sapiens
tcaaagtcctgggctcaagcgattctcccgcctcagcttccctaagtgttgggattacagacttgagccactgcatctagccacaactgagttcattattstgagctttctttgggatgttatttaactctcagtttcttcttctataagatggaaataataacaactaaaggctaggatttggggaaggtatggtaaatt

SEQ ID NO: 33148 - DNA, 201 bp, Homo sapiens
aaaatgaggaagaagcgaacgtgagaacccctggtaaacccatcagatcttgtgacacttattcactatcacgaggatagcgcaggaaagaccggcccacrtgattgagttacctcgccctgggtccctcccacaacatgtgggaattctgggagatataattcaagttgagatttgggtggagacacacccaaagcatat

SEQ ID NO: 33149 - DNA, 201 bp, Homo sapiens
aatatgtgatgcaatcaatcattgataagatgtactgttattttatgtttcactaagagtgcgaagaacattgttaattatacaatgatccaaaaatgtcwtctctctcagaatgtattgttttatatctattagaaaggctcttttgacttaggcatagatttctcatacatcaggccatttctatgcctgcctgtgaac

SEQ ID NO: 33150 - DNA, 201 bp, Homo sapiens
actctgtctcacaataaataaataaataaataaataaataaataaataagagttggatcacagcaaaggtgagctttaacgagttcagtctagctctctcwcaaaaaaaaagttaaaatgacaaattttgtgttacatacattgtactacaataaaaaccatttttttgaaaagaatagtacaaaaatgatacttccctct

SEQ ID NO: 33151 - DNA, 201 bp, Homo sapiens
caccagaacccgtctgcgccagtgtccctgcagcgccctctactggcgaagctggacatggcgtccgctggcaaaggggaaactcttctttcctcccaagscgagcaatgctaaatgtgcctggtactgagacgtcatctgtggacggttggcaccgatgctaatcagtgctatgggaaaataggcagagcgaggagcgta

SEQ ID NO: 33152 - DNA, 201 bp, Homo sapiens
atagagtgagactctgtctcaaacaaaaaaaaaatttaactctaaagaatccaagaatacagatttgggagcagccagtaccaatgggggatggggcagtwcacccaggaaagagcaaatctggggtccccacgggccaggactgggatctggactgggccatggcccattggatggcagaaaggttctcactgaagcccc

SEQ ID NO: 33153 - DNA, 201 bp, Homo sapiens
acttagctagcaaatggtggagtcgaattcaaaccctgcctctcctcacccactctgtttcttttcttttgagcacttaccactttctgaatatgtatacmattgtttcctcgattactgtctgcctcttcttccctagagcgtcagcccatgagcttatccagcctacagaggagatgctgcagcttggcagagcatgga

SEQ ID NO: 33154 - DNA, 201 bp, Homo sapiens
tgggtggtttgggcatttgtcaaagcagggtcagcagaaagctgacgtagttgggtctaaagtacaacaggactgagcatggtggctcacacctgtaattytagtgcattgggaggccaaggcaggaggattgcttgaggccaggtgttcaagaccagccttggcaatatagcaagacattgcctgtacaaaaaatttaaa

SEQ ID NO: 33155 - DNA, 201 bp, Homo sapiens
aaggacatcgttttgatatgatgaaccatgggtggtttgggcatttgtcaaagcagggtcagcagaaagctgacgtagttgggtctaaagtacaacaggamtgagcatggtggctcacacctgtaattctagtgcattgggaggccaaggcaggaggattgcttgaggccaggtgttcaagaccagccttggcaatatagc

SEQ ID NO: 33156 - DNA, 201 bp, Homo sapiens
caatccattggtcatcaggttctccagagaatcagaaccaataagagatgtcatacacaccacacacaaacacacacacacacacacacacacacacacamtaatatggttctgattctctggagaaccctgactaatacagaggcaagatcctgttttgacgtgcttgaactcgaggacttatgccgatgttaactctga

SEQ ID NO: 33157 - DNA, 201 bp, Homo sapiens
cgtcgcaaagtgctgggattacaggggtgagccaccacgtctggcctgacatcagtcttttcctgccttcagacttgaactgaagcatcagcatttcttgkgttttgatcttgctggagttggactgaaactacacatcagttctcctggctctccaccttgcctatagcggatcttgagactttttcttattttatctat

SEQ ID NO: 33158 - DNA, 201 bp, Homo sapiens; identical to SEQ ID NO: 8756

SEQ ID NO: 33159 - DNA, 201 bp, Homo sapiens; identical to SEQ ID NO: 14911

SEQ ID NO: 33160 - DNA, 201 bp, Homo sapiens
cactttggctttacaaaactgcttattttcaaatttttaaatggggacaaaaacgaatatgctatattatatacttttatttatataatttttttttcagyaactttttctcttttgaaaatgcaagagcctgaaaaacattgtgaatatacttgtaacattgcaaagctatttcaccagagtaaagatattttggttgtt

SEQ ID NO: 33161 - DNA, 201 bp, Homo sapiens
aaggaagagaccaatttaaaacattctaatgagcatcatctcataatttggtaatctcatgtaaaatgcttataataggggtgtgtgtatgttatatatayttttaaaataaatttgtaatcatgtatacagtagtccccccttatccgtggtgtttcagtttttttttttttgagtcagagtattactctgttgcccagg

SEQ ID NO: 33162 - DNA, 201 bp, Homo sapiens
gaggctgcagtgggctgtgattgtgccactgcattttcagcctgggtgacagaggaagaccctattacaaaaaaaaaaaaaaaaagggtctgttatcaacsatgcttttttattttattttattttattttcctgtttctgagttagagtctcttttgctcaggctggagtacagtggcgtgatcttggttcactgcagca

SEQ ID NO: 33163 - DNA, 201 bp, Homo sapiens
tagaacccactaacgctctatgtaactgtcttacgtgttccatttcttgtttctagactgtctccctccagtagaatgtgcgttctgctatacagcagtgytgtgtgacgcgatagcaggtcctttttaaacatctgttgaaggagaaaatgaaggcacacgtggccttgctgacatctgagtttgcaacttcttttatgc

SEQ ID NO: 33164 - DNA, 201 bp, Homo sapiens; identical to SEQ ID NO: 14912

SEQ ID NO: 33165 - DNA, 201 bp, Homo sapiens; identical to SEQ ID NO: 14913

SEQ ID NO: 33166 - DNA, 201 bp, Homo sapiens; identical to SEQ ID NO: 8757

SEQ ID NO: 33167 - DNA, 201 bp, Homo sapiens
caaattgtcccgttgtctcttggctggtcttgccagctggcacacagcttcctctgaccaccctgctaggtacaaatcccacatgaaaagtctcaatcacstggctcaaactcatagttttcaggtggcataagccatggcattttcacctcctttcctggttgtttccagaaagggatgatagccccagtgcagtggctc

SEQ ID NO: 33168 - DNA, 201 bp, Homo sapiens
acccaatccgctcatattcttgcatttgctgcagcaaaacctgacctctctttgtgttacctgagtcttgacgaagaagactgaggaaaggcccccccccscccccaccaaattgtcccgttgtctcttggctggtcttgccagctggcacacagcttcctctgaccaccctgctaggtacaaatcccacatgaaaagtct

SEQ ID NO: 33169 - DNA, 201 bp, Homo sapiens
tcttttcacattttgttttgtgcttgcttatttattgaaatctggaccacaaataacttacatgtttgtcaaggccagatttcaggacctaaccaacaccygacaggcatcttagaaagtggagggtgtaagttataaagagagattacttccaacacgtttctttaaagcctgctggctaaattaggtgggaccttcttt

SEQ ID NO: 33170 - DNA, 201 bp, Homo sapiens
atacatatatatatgtatataactttgcatattttaattgctgtctggaatcctccttcagatggaatgagaaatcatctctgggttagttctgtccctgraggtgagggccagacaacacatcaaaactgactttttattttttttcaaagttgttaagactatctaagattcagatctccctaatactgttcctagtta

SEQ ID NO: 33171 - DNA, 201 bp, Homo sapiens
tatatatatatagatatatatagatatatgtatatatacatatatatatgtatataactttgcatattttaattgctgtctggaatcctccttcagatggratgagaaatcatctctgggttagttctgtccctgaaggtgagggccagacaacacatcaaaactgactttttattttttttcaaagttgttaagactatc

SEQ ID NO: 33172 - DNA, 201 bp, Homo sapiens
tatatatatatatatagatatatatagatatatgtatatatacatatatatatgtatataactttgcatattttaattgctgtctggaatcctccttcagmtggaatgagaaatcatctctgggttagttctgtccctgaaggtgagggccagacaacacatcaaaactgactttttattttttttcaaagttgttaagac

SEQ ID NO: 33173 - DNA, 201 bp, Homo sapiens
cagaaagcctagctccccagcttctcctgaatctacgtttttctattttgtctgaactagccaaggtctctggagtttgctgttatattgcttcagagaamttagtgacattgaaaggctgttgtcttttttagtgtacttttggttgttaggagaaatttacaaggccatttttttctcccgtctctgcagttcaggaga

SEQ ID NO: 33174 - DNA, 201 bp, Homo sapiens
gcagaaagcctagctccccagcttctcctgaatctacgtttttctattttgtctgaactagccaaggtctctggagtttgctgttatattgcttcagagamattagtgacattgaaaggctgttgtcttttttagtgtacttttggttgttaggagaaatttacaaggccatttttttctcccgtctctgcagttcaggag

SEQ ID NO: 33175 - DNA, 201 bp, Homo sapiens
ccaggcctgttggaatgtctgccagtttcaacccacggggatagggtgagatgaacattgattgagcctttacatcggagacactataacaaatgctttgygtacatcagctctttcaaattaatacaattctactagaggggacactattagtatccccaatttacagatgaaaaaaatgagggacagagaggttagatg

SEQ ID NO: 33176 - DNA, 201 bp, Homo sapiens
agaaaaaaaaaaaaaaaaacaactaccaggcctgttggaatgtctgccagtttcaacccacggggatagggtgagatgaacattgattgagcctttacatyggagacactataacaaatgctttgtgtacatcagctctttcaaattaatacaattctactagaggggacactattagtatccccaatttacagatgaaaa

SEQ ID NO: 33177 - DNA, 201 bp, Homo sapiens
tattgagtacttagtatgtgctggttgcagagccaagtcttttttttttttttttttttcctccttttttgagagagagagtctcactctgtcacccagamtggattgcagtggcacaatctcaactgactgcaacctgcacctctcaggttcaagcaattatcaggcctcaacgtcctgagaagctgggactacaggcat

SEQ ID NO: 33178 - DNA, 201 bp, Homo sapiens
gagaggggacaggaggtgactagatttggaaggaaaattagaaaacttttggccgggcatggtggctcatgcctgtaatcccagcacttttgggtcagttkagtctaacataggggtgtccaaacttttggcttccctgggccacattggaagaaaaagaattgtctttggctgcacataatatacaattgttgatgagct

SEQ ID NO: 33179 - DNA, 201 bp, Homo sapiens
cctgggcgacagaggaagactctgtctcaaaataaacaaacaaataaataaataaaaattgtttaaacctgccaactacaataactttttcagtctctttytccctttcccaccttcccaaaagggtgggaaatttttaaagtaaagtaataaacaaataagttttgggttgggcgggagattagttagagacaggatctg

SEQ ID NO: 33180 - DNA, 201 bp, Homo sapiens
gctacatttaatctttatggtagcctcatgaacaggctcttatttagttcagtggttcttgatcaggagtgatattgcctgccagggaatgcatgtcaatrtctggagacatctggggttgtcagttcaggagggtagaggataggggggaaaaggtgctactggcatctagtgggcaaaggccagggatagtgctaagga

SEQ ID NO: 33181 - DNA, 201 bp, Homo sapiens
acacttgccattctcaatggacaaagggagtggggagtgtgggggtgtgctttggggttagtctctgggttttcgaaacttagcattctcagattcccagscaactggtttcacatgacaagtaaatgagcaacctggaagatgagtggcgtttccacacacagggaagcagatagttccattaggtgacagtgtgtgcac

SEQ ID NO: 33182 - DNA, 201 bp, Homo sapiens
cgggaagtggaggttgcagtgagccgagatcttgccattgttctccagcctgggcgacaagagtgaaactccatctcaaaaaaaaaaaaaaaaaaaaaaaraattatgtcatttcgttgtcacagcgtcagcagaataaatcttagatcaagatgggattactgcgccactcccttcttcccagtctgtggtttagcacgg

SEQ ID NO: 33183 - DNA, 201 bp, Homo sapiens
acggagggagatggaggatgacagggagatggagggaggcaaaaagaaaaagggagaaggaaagagaggaaagaggggaagggaggaaggaaagaagagakagaaggaggaagagagggaaggaggcacagaggtagagaggcagggagataatggagatcctggccaaaagttaatgctccgtttctagtagtccacaga

SEQ ID NO: 33184 - DNA, 201 bp, Homo sapiens
tgtagtggcacaatcccggctcactgcaacctccgcgcctccccagttcaagcaattctcctgcctcagcctcccaagtagctgggattacaagcactggmcaccaaacccagctaatttatatatttttagtagaagcggggtttcaacatgttggccaggctggtctcaaactcctgacctcaggtgatccacctgcct

SEQ ID NO: 33185 - DNA, 201 bp, Homo sapiens
cagcctagaatactcctcctccactcttaatttctacccatcctgcaaaactcagtctgaacagcacacgtcaaggaagcagttttggtctctcagattayatgaagctctccaatatgttctttcagaacagccagtgcctagaatactgcctgactcgtagtagcactccttatgtgttgaatgagtaaatgaagagtc

SEQ ID NO: 33186 - DNA, 201 bp, Homo sapiens
tgcactttctaaatggcctacttaaaccttgaggtaggtccttcagtttcccataaattaataacacatctatgaatatttcccagccagtcttagaagcsccagtctattccaataccaggattgtaaacacagggaatagatgaagcaagctgcttctttcaaatgctcttccaatatgaagcaaaatattattgatct

SEQ ID NO: 33187 - DNA, 201 bp, Homo sapiens
taaataatgtttgttggccaggcgtggtggctcatgcctgtaaccccagcactctggaaggctgagtcagaacgattgcttgagctgaattgttcaagacygccctgggcagcacagtgagaccccgtatctacaaaaaataaacaaacttagccaggtgcggaggcattcacctgtattcctagctactcaggaagctga

SEQ ID NO: 33188 - DNA, 201 bp, Homo sapiens
cgctggtgtttaggtgggcttgagaaaagtgctgactttgtgaacgaggaggagggaaagggtccagagcagtaaagagcctgtaaataaattcataccarcttcagccccatgctttcgtttgggattcctcatccaaccctgacggcttccctgcgggacatatttccccctcttacagataggaaaccttgcccaatg

SEQ ID NO: 33189 - DNA, 201 bp, Homo sapiens
cgtcgcagatgttatttttttgaagagggtgtaggccaagaaaggggtgggagaaacgagcaaggtgttgatagaaccccttagtgtcctcctcataccasagacactctcttcccccacttacttggccaatttttttttttttttttttttttttttggtggagtctcgttctgtctcccaggctggagtgcaatggtg

SEQ ID NO: 33190 - DNA, 201 bp, Homo sapiens
ggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagac

SEQ ID NO: 33191 - DNA, 201 bp, Homo sapiens
gcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctc

SEQ ID NO: 33192 - DNA, 201 bp, Homo sapiens
tcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgac

SEQ ID NO: 33193 - DNA, 201 bp, Homo sapiens
aagaaagtacacaaatggagagagggggaattggacatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcc

SEQ ID NO: 33194 - DNA, 201 bp, Homo sapiens
aaaatcacttttaaaaaatgtatggtgtccatctgggttagcaaacacatgctcacacgtctgtgcttgctggatttttaagaacttaccagcatttaagrttttcttatgaaactgattttactcaccagggatagagtctcaaagttggaggtattttatgttgttttaaataatatcgtcatcacatgtcattttaga

SEQ ID NO: 33195 - DNA, 201 bp, Homo sapiens
taaaactctgcctttctaaagaaacagggacacggtgcagaaaagttcatctggagttaggcttgtgtcttgctgtctctttaacggagagttcatgggcwgggtacagtctgtgagaaggaatgaaaaccccagggtagatgctaacaaaaatcacttttaaaaaatgtatggtgtccatctgggttagcaaacacatgc

SEQ ID NO: 33196 - DNA, 201 bp, Homo sapiens
gcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaa

SEQ ID NO: 33197 - DNA, 201 bp, Homo sapiens
gcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgc

SEQ ID NO: 33198 - DNA, 201 bp, Homo sapiens
cacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagt

SEQ ID NO: 33199 - DNA, 201 bp, Homo sapiens
tatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgcc

SEQ ID NO: 33200 - DNA, 201 bp, Homo sapiens
gattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttg

SEQ ID NO: 33201 - DNA, 201 bp, Homo sapiens
taatctttcccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatg

SEQ ID NO: 33202 - DNA, 201 bp, Homo sapiens
ctatcacatttagaaacgccccttgccttccttccaggactttcttccttaatcaggattgacttaactgttaactcctagaactgtcgttgattgcttgstgaagtaacaattagtatagacattcagcaactggcctcccatactgtgattcactgacccagactttgacatcttgggctcagccataccctggagcct

SEQ ID NO: 33203 - DNA, 201 bp, Homo sapiens
ctttctaatgcagaaggtgtagacacagggcacagaactgccaactgtggctgctgacacctgtctgactttgactgggttagtgacaaagaaatgacttkccttttgtatgttagccctgtgcctggcatactgcaaatatctatggttgataaattaatgttatcatcatcacgtaagcatcttgggaagtctgtaagt

SEQ ID NO: 33204 - DNA, 201 bp, Homo sapiens
tgtttaaatgctcaaacttggtatggaactgcacagactatacggctgctctccactcaagaatacaaattgaacattgactttcctcattttttatccarttttgctttccagagacccagatatggcttcattttttaaatgaaattttgcaggtcattagctcataatgattaaatgattctggttattagcataaaa

SEQ ID NO: 33205 - DNA, 201 bp, Homo sapiens
cccagagtgctgggattccaggcgtgagtcaccatgccaggcccctgcctctgtttaaatgctcaaacttggtatggaactgcacagactatacggctgcyctccactcaagaatacaaattgaacattgactttcctcattttttatccagttttgctttccagagacccagatatggcttcattttttaaatgaaattt

SEQ ID NO: 33206 - DNA, 201 bp, Homo sapiens
ggaaaagctcattttccagtttttccccctccagctgtaggggatatattttcgttaattcctgtgaccatatggcagcatggttaggatcttgggcttcyaaatcagacagttgtaaacttaaactccaattctgccacttattgtgtcactttggacaagttacttcacctctccaagcctcagtttccctgactataa

SEQ ID NO: 33207 - DNA, 201 bp, Homo sapiens
gtgagccacggttggccagctcccaaacaccatgacatacaacttgcaggaaaagctcattttccagtttttccccctccagctgtaggggatatattttygttaattcctgtgaccatatggcagcatggttaggatcttgggcttctaaatcagacagttgtaaacttaaactccaattctgccacttattgtgtcact

SEQ ID NO: 33208 - DNA, 201 bp, Homo sapiens
cccttatcagagatcaattggccataaatgtaagtatttctttctggactctgaattatatcccattgatctgtatgcctgtccttatgccattgccacaytgttttggttactgtactctgtgtaagttttgaaatttggaattgtgaattctccaactttgttcttcattttcaagattgttttgggtattctgggtcc

SEQ ID NO: 33209 - DNA, 201 bp, Homo sapiens
tctattaaatggtctttgcacccttatcagagatcaattggccataaatgtaagtatttctttctggactctgaattatatcccattgatctgtatgcctrtccttatgccattgccacactgttttggttactgtactctgtgtaagttttgaaatttggaattgtgaattctccaactttgttcttcattttcaagatt

SEQ ID NO: 33210 - DNA, 201 bp, Homo sapiens
tctcgcatttggtgagaggagtcttctgtgttgattgtcatggtggtgtgagagcagaagggaaacatggtttcagaaaagagtttttccctgaaaccacycctctattttcttctcagacttttatagttttagcacttatgttaagacttttgatccattttacgtcaatttttctatatagtttaaggtaggcattca

SEQ ID NO: 33211 - DNA, 201 bp, Homo sapiens
cataaccacatctactttgtgtctctatagatttgactattctggatatctcatataaatggaatcacacaatatgtggccttttgtgtctggcttcttgsttttagcatgctttcaaggttcatccatgttgtagaatgtatcagtacttcattctttttatggttgagtgatattctgttacatggatataccactttt

SEQ ID NO: 33212 - DNA, 201 bp, Homo sapiens
accatcccccgctaaagaaacaccatatccattaagtggtcattccccatttcctccttcccccagcccctcataaccacatctactttgtgtctctatasatttgactattctggatatctcatataaatggaatcacacaatatgtggccttttgtgtctggcttcttgcttttagcatgctttcaaggttcatccatg

SEQ ID NO: 33213 - DNA, 201 bp, Homo sapiens; identical to SEQ ID NO: 14914

SEQ ID NO: 33214 - DNA, 201 bp, Homo sapiens; identical to SEQ ID NO: 14915

SEQ ID NO: 33215 - DNA, 201 bp, Homo sapiens; identical to SEQ ID NO: 14916

SEQ ID NO: 33216 - DNA, 201 bp, Homo sapiens; identical to SEQ ID NO: 14917

SEQ ID NO: 33217 - DNA, 201 bp, Homo sapiens; identical to SEQ ID NO: 14918

SEQ ID NO: 33218 - DNA, 201 bp, Homo sapiens; identical to SEQ ID NO: 14919

SEQ ID NO: 33219 - DNA, 201 bp, Homo sapiens; identical to SEQ ID NO: 14920

SEQ ID NO: 33220 - DNA, 201 bp, Homo sapiens; identical to SEQ ID NO: 14921

SEQ ID NO: 33221 - DNA, 201 bp, Homo sapiens; identical to SEQ ID NO: 14922

SEQ ID NO: 33222 - DNA, 201 bp, Homo sapiens; identical to SEQ ID NO: 14923

SEQ ID NO: 33223 - DNA, 201 bp, Homo sapiens; identical to SEQ ID NO: 14924

SEQ ID NO: 33224 - DNA, 201 bp, Homo sapiens; identical to SEQ ID NO: 14925

SEQ ID NO: 33225 - DNA, 201 bp, Homo sapiens
tggtgccctcacctcttaagacaagcacctatcgttttcctgtgtattccaagaggccagtgtggctggtggaataagatgttttcctgttttcaagatgsagtggactctcttttatttagcagcagtgtctatgtgttaggaatccatgtgagttctctaagtctgggacaacgataggtgtgtctgagtcctgcatta

SEQ ID NO: 33226 - DNA, 201 bp, Homo sapiens
cagtatctattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtgggg

SEQ ID NO: 33227 - DNA, 201 bp, Homo sapiens
tggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttc

SEQ ID NO: 33228 - DNA, 201 bp, Homo sapiens
tttcaatagagttgatatcgggtctatttattttgtgggagtgaagggatagggatagtactgacagcattatgtgattgcagcctcattgataagcatcrgaaataatgactttaacattattttcagatagggagcactcagtaccaaccattatattaggctcatgggctcaacattttgctgtgcttttcatagata

SEQ ID NO: 33229 - DNA, 201 bp, Homo sapiens
attgataagcatcggaaataatgactttaacattattttcagatagggagcactcagtaccaaccattatattaggctcatgggctcaacattttgctgtrcttttcatagatactgacacctgtgttttcattttgttgttgttgttgttttccctgccgggaaactgccgcatcctgtgttttcatggcatgatattaa

SEQ ID NO: 33230 - DNA, 201 bp, Homo sapiens
cattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtggga

SEQ ID NO: 33231 - DNA, 201 bp, Homo sapiens
ttctgtatagtattggattttcaataaataaagtatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttg

SEQ ID NO: 33232 - DNA, 201 bp, Homo sapiens
cacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttg

SEQ ID NO: 33233 - DNA, 201 bp, Homo sapiens
ttgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaa

SEQ ID NO: 33234 - DNA, 201 bp, Homo sapiens
gactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaataggatgggaaag

SEQ ID NO: 33235 - DNA, 201 bp, Homo sapiens
atatggtgtcagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtg

SEQ ID NO: 33236 - DNA, 201 bp, Homo sapiens
tggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagaga

SEQ ID NO: 33237 - DNA, 201 bp, Homo sapiens
ggcagctggagagcgtgcagactcaggagccaagacctgccttgccttccctggagttaatgaatcagtgtgaatgaagagcacagtcttcttttaaatgrcaggggaaccgtgcacttatttaccggcaattctcagattctaattgttccgactacaatgcgtcctgtaaaccgggtagctgggagaaacttcaatgca

SEQ ID NO: 33238 - DNA, 201 bp, Homo sapiens
agcgtgcagactcaggagccaagacctgccttgccttccctggagttaatgaatcagtgtgaatgaagagcacagtcttcttttaaatggcaggggaaccrtgcacttatttaccggcaattctcagattctaattgttccgactacaatgcgtcctgtaaaccgggtagctgggagaaacttcaatgcatctttgtaatg

SEQ ID NO: 33239 - DNA, 201 bp, Homo sapiens
caaatgtttacatggggctgtggaccattttgtatcattggaggagaagccagggcacttggcaggggtgttcatgatgataatcaggtggctgggtggastcaccatttgtggcatcctcaaagacttgccaacatagacatttttggggagacagaaacacagaaataattctgcagtgctttaaagaatctgttaaaa

SEQ ID NO: 33240 - DNA, 201 bp, Homo sapiens
cacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacctaatagggtgaaaaattgaggtatgaattagtaaagtcatttgtccttctggaaagagtt

SEQ ID NO: 33241 - DNA, 201 bp, Homo sapiens
gcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctct

SEQ ID NO: 33242 - DNA, 201 bp, Homo sapiens
gggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgc

SEQ ID NO: 33243 - DNA, 201 bp, Homo sapiens
tcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagccctactgggtaaatccagctgcac

SEQ ID NO: 33244 - DNA, 201 bp, Homo sapiens
tgggcctttaggtagaatgaacagcttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgct

SEQ ID NO: 33245 - DNA, 201 bp, Homo sapiens
ggtatacatgagtgctattgggcaaatccagctgcacaggagagtaaggggcatatgttagggctagtgggtaaacccagctgcacctgagagtaggggtrtatgttagggcttgtgggtaaatccagttgcacctggcagttggggcatatgttagggctagtgggtaaacccagccgcaccggagagttgtgggtatat

SEQ ID NO: 33246 - DNA, 201 bp, Homo sapiens
tacatgagtgctattgggcaaatccagctgcacaggagagtaaggggcatatgttagggctagtgggtaaacccagctgcacctgagagtaggggtatatsttagggcttgtgggtaaatccagttgcacctggcagttggggcatatgttagggctagtgggtaaacccagccgcaccggagagttgtgggtatatgtta

SEQ ID NO: 33247 - DNA, 201 bp, Homo sapiens
agctgcacctgagagtaggggtatatgttagggcttgtgggtaaatccagttgcacctggcagttggggcatatgttagggctagtgggtaaacccagccrcaccggagagttgtgggtatatgttagggccagtgggtaaatccagctccatctgagatatggggtatacatgaatactagtgggtaaatccagctgtac

SEQ ID NO: 33248 - DNA, 201 bp, Homo sapiens
cacctgagagtaggggtatatgttagggcttgtgggtaaatccagttgcacctggcagttggggcatatgttagggctagtgggtaaacccagccgcaccsgagagttgtgggtatatgttagggccagtgggtaaatccagctccatctgagatatggggtatacatgaatactagtgggtaaatccagctgtacacgag

SEQ ID NO: 33249 - DNA, 201 bp, Homo sapiens
tggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtgtcatcgagagagagaaggttgatccgaagttagtaaaggcttt

SEQ ID NO: 33250 - DNA, 201 bp, Homo sapiens
ttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacac

SEQ ID NO: 33251 - DNA, 201 bp, Homo sapiens
ccccatcaacatgatggcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccac

SEQ ID NO: 33252 - DNA, 201 bp, Homo sapiens
atgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattga

SEQ ID NO: 33253 - DNA, 201 bp, Homo sapiens
ttaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctt

SEQ ID NO: 33254 - DNA, 201 bp, Homo sapiens
gacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaa

SEQ ID NO: 33255 - DNA, 201 bp, Homo sapiens
aagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtattttta

SEQ ID NO: 33256 - DNA, 201 bp, Homo sapiens
gtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatatggcgaaaccctgtct

SEQ ID NO: 33257 - DNA, 201 bp, Homo sapiens
aggctgaggcaggtggatcacttgtggtcaggagtttgagaccagcctggccaatatggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgcca

SEQ ID NO: 33258 - DNA, 201 bp, Homo sapiens
ggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactcca

SEQ ID NO: 33259 - DNA, 201 bp, Homo sapiens
gctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcaagccacattagaaagcagttac

SEQ ID NO: 33260 - DNA, 201 bp, Homo sapiens
tctgttgtccttcctttaccttaacttcagcagggcaagaatggttcaagccacattagaaagcagttactttctcacccaattttaaaggagaaaggtaratgcggtgggttctagggatttcagtgacgtaacaggtgtttcccaggcattaagacctagtaaggtttccatttccattaggtattatggatgcattcc

SEQ ID NO: 33261 - DNA, 201 bp, Homo sapiens
ccaattttaaaggagaaaggtagatgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtt

SEQ ID NO: 33262 - DNA, 201 bp, Homo sapiens
caagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagag

SEQ ID NO: 33263 - DNA, 201 bp, Homo sapiens
tacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccg

SEQ ID NO: 33264 - DNA, 201 bp, Homo sapiens
ttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggta

SEQ ID NO: 33265 - DNA, 201 bp, Homo sapiens
accagtccctagcctgtggagaaggggcaatctcttatctgaaggcctaggaggtgcagggatgtttatatgggctgctagcgcttagtttcctgccacarggagacagtaagaaaggtgacgtcaatctgagatgagagagagagcaaaacagttcttttgaccaccttgaccccgaccttgaaataaggtggaactaat

SEQ ID NO: 33266 - DNA, 201 bp, Homo sapiens
tccacaatgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccag

SEQ ID NO: 33267 - DNA, 201 bp, Homo sapiens
gtttggtggaattaacatagatttcccacatggggaaggttttgggtgaggatttagaacaaggcaggttcttgatcctcggaagagattcttatctgagrggggatttgagaatggcattgcagagtgggaggcgctgctgtgtggaaaaatgaactggaataattattagaacagttctcagaatttacaggatatttg

SEQ ID NO: 33268 - DNA, 201 bp, Homo sapiens
aggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagtt

SEQ ID NO: 33269 - DNA, 201 bp, Homo sapiens
gatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtg

SEQ ID NO: 33270 - DNA, 201 bp, Homo sapiens
taggacccatatccctggattgttgaggaaatacgtgaacatatgtggcacacattatagtgtctggcatacaataaatactttgtaatgttactggtgtyttcttaccgttattgtctcactggtgaccgtttgaaatgttgaagctttattattacagataatggtggatatagtctcttccttgtttattttttgaca

SEQ ID NO: 33271 - DNA, 201 bp, Homo sapiens
atactttgtaatgttactggtgtcttcttaccgttattgtctcactggtgaccgtttgaaatgttgaagctttattattacagataatggtggatatagtstcttccttgtttattttttgacagaatctttttttaaaaaagtttttatttgtttggtgagaatttacttgttacaggtctagtgctgttatagttgaat

SEQ ID NO: 33272 - DNA, 201 bp, Homo sapiens
ttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataa

SEQ ID NO: 33273 - DNA, 201 bp, Homo sapiens
gtaacaaacaatcccagactctcaaggcttgcaaaaataaatgtgtgtttgtttgctcataacacatgtggctgagggttggccgtggctccacagtcacrggtgggctttcctgggctcagcttctcacagcgtctccttgcagggcccaggctgtaggagatgtcatcagggcctgcagagggcaaaacctcacagagg

SEQ ID NO: 33274 - DNA, 201 bp, Homo sapiens
cacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcaccctggagagcccagcccttccacttgttcagatctcagtctctcatctgg

SEQ ID NO: 33275 - DNA, 201 bp, Homo sapiens
ctaactgggaccccagtgggcttccctgctacaccctctgaggttccccagacctgccaagctgttccatccccagttccttggtgcctgctggtacttcmccctggagagcccagcccttccacttgttcagatctcagtctctcatctgggagggacagcttgagcactatgacctgtgtgaagcttttcccagtgctg

SEQ ID NO: 33276 - DNA, 201 bp, Homo sapiens
ttggcgtgagctgagatcgcaccactgcactccggcctgggtgacagagcaagactctgcctcaaaaaaaaaaaaaaaaaaagaaaaaaaaaagattgaamatgtggaatatgagacaaatgaaaaagattgaattccgttccaactgggcttttgaatttattttcgcacttcctattttttgagcccgggagtgcaaga

SEQ ID NO: 33277 - DNA, 201 bp, Homo sapiens
ctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtcgtgtggaaattaacattactggtcctgaggaaaga

SEQ ID NO: 33278 - DNA, 201 bp, Homo sapiens
attgcattgcaaataatagcagttagtgggagttgagagccagctctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcat

SEQ ID NO: 33279 - DNA, 201 bp, Homo sapiens
cccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttggg

SEQ ID NO: 33280 - DNA, 201 bp, Homo sapiens
gtagtttaactaaaaagtggccactgtctcctggtagcggttggtaagccatccagtctctgcaggcatctacgctccaggtctccagtctgaggagtctsgctcctggggcaggtgcctctgggggtctctgccaggcttgtctggtcatgcagctacttccagactgattcctagatcttgcatttttacataggacat

SEQ ID NO: 33281 - DNA, 201 bp, Homo sapiens
aactaaaaagtggccactgtctcctggtagcggttggtaagccatccagtctctgcaggcatctacgctccaggtctccagtctgaggagtctcgctcctrgggcaggtgcctctgggggtctctgccaggcttgtctggtcatgcagctacttccagactgattcctagatcttgcatttttacataggacatccccagc

SEQ ID NO: 33282 - DNA, 201 bp, Homo sapiens
ccctagttgtatcaccttcctcccattatgtttgtaacttcagattttgtatatttcgcatatgtcaatatgtaaacattttatatatatatatatgcatkcacacacatgcatacatatatgtaatggtatatatacatgtaagtttccatttttgctcaaattgctctggacagttctttgctctgggagttctttact

SEQ ID NO: 33283 - DNA, 201 bp, Homo sapiens
gttgcagtgagcccagatcgcaccactgcactccagcctgggtgacagagcgagactccatctcaaacaaacaaacaaacaaacaaacaaactaagaacarcaacgaaaaaactcccatgtattatctatggattgactgtaaaatatgagaagcaataaatatgttcatcactagggccatctagaaatttctaacccaa

SEQ ID NO: 33284 - DNA, 201 bp, Homo sapiens
gagaagcaataaatatgttcatcactagggccatctagaaatttctaacccaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgct

SEQ ID NO: 33285 - DNA, 201 bp, Homo sapiens
tgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcac

SEQ ID NO: 33286 - DNA, 201 bp, Homo sapiens
ttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaatttt

SEQ ID NO: 33287 - DNA, 201 bp, Homo sapiens
cccctttcctttcccaaacttttactagcttcttccatcctggacttgcaatctggctgaaaacctgctaaataagggaacaattttgacatggctcctgkactccccacaaacctagttgattccagaccagtaatgtcttggggacagtgttgtcccatcttcctttctaggctgggctcagattactgacgtggaaga

SEQ ID NO: 33288 - DNA, 201 bp, Homo sapiens
actagcttcttccatcctggacttgcaatctggctgaaaacctgctaaataagggaacaattttgacatggctcctgtactccccacaaacctagttgatyccagaccagtaatgtcttggggacagtgttgtcccatcttcctttctaggctgggctcagattactgacgtggaagagttgttggtcctggtgcaacatg

SEQ ID NO: 33289 - DNA, 201 bp, Homo sapiens
atagaagtttatgacggaaaaggcaaaattctctgtgtctttatggggagatattcgatatgttttttcttggcagaaataaaacatattcaataatatamttaggcaaacttgttttacttgacaagaagaccgtatctccgtctgcaagatgaaggcaagatcaagagatgtcagttaacattcttgcgaccacaggta

SEQ ID NO: 33290 - DNA, 201 bp, Homo sapiens
ggaaaaggcaaaattctctgtgtctttatggggagatattcgatatgttttttcttggcagaaataaaacatattcaataatataattaggcaaacttgtkttacttgacaagaagaccgtatctccgtctgcaagatgaaggcaagatcaagagatgtcagttaacattcttgcgaccacaggtagggaggagaactggg

SEQ ID NO: 33291 - DNA, 201 bp, Homo sapiens
aaggcaaaattctctgtgtctttatggggagatattcgatatgttttttcttggcagaaataaaacatattcaataatataattaggcaaacttgttttasttgacaagaagaccgtatctccgtctgcaagatgaaggcaagatcaagagatgtcagttaacattcttgcgaccacaggtagggaggagaactggggagg

SEQ ID NO: 33292 - DNA, 201 bp, Homo sapiens
gttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattct

SEQ ID NO: 33293 - DNA, 201 bp, Homo sapiens
gggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttg

SEQ ID NO: 33294 - DNA, 201 bp, Homo sapiens
tcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattc

SEQ ID NO: 33295 - DNA, 201 bp, Homo sapiens
gccacttgcagaccttggcagttgctgttgctcctgctgctgctgctgctgctgcattgtcaagactacattgatgtcttggaaatatagaaaaaagaggmtgctggactgtgtgcttagaatcagtgtgctaactctgttaccaacaccgtagagaagtggttccagaaggaagagttcagggtgagaatgaataacgga

SEQ ID NO: 33296 - DNA, 201 bp, Homo sapiens
ctgttgctcctgctgctgctgctgctgctgcattgtcaagactacattgatgtcttggaaatatagaaaaaagaggctgctggactgtgtgcttagaatcwgtgtgctaactctgttaccaacaccgtagagaagtggttccagaaggaagagttcagggtgagaatgaataacggagtggctttgcagtgggaacctggc

SEQ ID NO: 33297 - DNA, 201 bp, Homo sapiens
gcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagc

SEQ ID NO: 33298 - DNA, 201 bp, Homo sapiens
agctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgta

SEQ ID NO: 33299 - DNA, 201 bp, Homo sapiens; identical to SEQ ID NO: 8758

SEQ ID NO: 33300 - DNA, 201 bp, Homo sapiens; identical to SEQ ID NO: 8759

SEQ ID NO: 33301 - DNA, 201 bp, Homo sapiens; identical to SEQ ID NO: 8760

SEQ ID NO: 33302 - DNA, 201 bp, Homo sapiens; identical to SEQ ID NO: 8761

SEQ ID NO: 33303 - DNA, 201 bp, Homo sapiens; identical to SEQ ID NO: 8762

SEQ ID NO: 33304 - DNA, 201 bp, Homo sapiens; identical to SEQ ID NO: 8763

SEQ ID NO: 33305 - DNA, 201 bp, Homo sapiens; identical to SEQ ID NO: 8764

SEQ ID NO: 33306 - DNA, 201 bp, Homo sapiens; identical to SEQ ID NO: 8765

SEQ ID NO: 33307 - DNA, 201 bp, Homo sapiens; identical to SEQ ID NO: 8766

SEQ ID NO: 33308 - DNA, 201 bp, Homo sapiens; identical to SEQ ID NO: 8767

SEQ ID NO: 33309 - DNA, 201 bp, Homo sapiens; identical to SEQ ID NO: 8768

SEQ ID NO: 33310 - DNA, 201 bp, Homo sapiens; identical to SEQ ID NO: 8769

SEQ ID NO: 33311 - DNA, 201 bp, Homo sapiens; identical to SEQ ID NO: 8770

SEQ ID NO: 33312 - DNA, 201 bp, Homo sapiens; identical to SEQ ID NO: 8771

SEQ ID NO: 33313 - DNA, 201 bp, Homo sapiens; identical to SEQ ID NO: 8772

SEQ ID NO: 33314 - DNA, 201 bp, Homo sapiens; identical to SEQ ID NO: 8773

SEQ ID NO: 33315 - DNA, 201 bp, Homo sapiens; identical to SEQ ID NO: 8774

SEQ ID NO: 33316 - DNA, 201 bp, Homo sapiens; identical to SEQ ID NO: 8775

SEQ ID NO: 33317 - DNA, 201 bp, Homo sapiens; identical to SEQ ID NO: 8776

SEQ ID NO: 33318 - DNA, 201 bp, Homo sapiens; identical to SEQ ID NO: 8777

SEQ ID NO: 33319 - DNA, 201 bp, Homo sapiens; identical to SEQ ID NO: 8778

SEQ ID NO: 33320 - DNA, 201 bp, Homo sapiens; identical to SEQ ID NO: 8779

SEQ ID NO: 33321 - DNA, 201 bp, Homo sapiens; identical to SEQ ID NO: 8780

SEQ ID NO: 33322 - DNA, 201 bp, Homo sapiens; identical to SEQ ID NO: 8781

SEQ ID NO: 33323 - DNA, 201 bp, Homo sapiens; identical to SEQ ID NO: 8782

SEQ ID NO: 33324 - DNA, 201 bp, Homo sapiens; identical to SEQ ID NO: 8783

SEQ ID NO: 33325 - DNA, 201 bp, Homo sapiens; identical to SEQ ID NO: 8784

SEQ ID NO: 33326 - DNA, 201 bp, Homo sapiens; identical to SEQ ID NO: 8785

SEQ ID NO: 33327 - DNA, 201 bp, Homo sapiens; identical to SEQ ID NO: 8786

SEQ ID NO: 33328 - DNA, 201 bp, Homo sapiens; identical to SEQ ID NO: 8787

SEQ ID NO: 33329 - DNA, 201 bp, Homo sapiens; identical to SEQ ID NO: 8788

SEQ ID NO: 33330 - DNA, 201 bp, Homo sapiens; identical to SEQ ID NO: 8789

SEQ ID NO: 33331 - DNA, 201 bp, Homo sapiens; identical to SEQ ID NO: 8790

SEQ ID NO: 33332 - DNA, 201 bp, Homo sapiens; identical to SEQ ID NO: 8791

SEQ ID NO: 33333 - DNA, 201 bp, Homo sapiens; identical to SEQ ID NO: 8792

SEQ ID NO: 33334 - DNA, 201 bp, Homo sapiens; identical to SEQ ID NO: 8793

SEQ ID NO: 33335 - DNA, 201 bp, Homo sapiens; identical to SEQ ID NO: 8794

SEQ ID NO: 33336 - DNA, 201 bp, Homo sapiens; identical to SEQ ID NO: 8795

SEQ ID NO: 33337 - DNA, 201 bp, Homo sapiens; identical to SEQ ID NO: 8796

SEQ ID NO: 33338 - DNA, 201 bp, Homo sapiens; identical to SEQ ID NO: 8797

SEQ ID NO: 33339 - DNA, 201 bp, Homo sapiens; identical to SEQ ID NO: 8798

SEQ ID NO: 33340 - DNA, 201 bp, Homo sapiens; identical to SEQ ID NO: 8799

SEQ ID NO: 33341 - DNA, 201 bp, Homo sapiens; identical to SEQ ID NO: 8800

SEQ ID NO: 33342 - DNA, 201 bp, Homo sapiens; identical to SEQ ID NO: 8801

SEQ ID NO: 33343 - DNA, 201 bp, Homo sapiens; identical to SEQ ID NO: 8802

SEQ ID NO: 33344 - DNA, 201 bp, Homo sapiens; identical to SEQ ID NO: 8803

SEQ ID NO: 33345 - DNA, 201 bp, Homo sapiens; identical to SEQ ID NO: 8804

SEQ ID NO: 33346 - DNA, 201 bp, Homo sapiens; identical to SEQ ID NO: 8805

SEQ ID NO: 33347 - DNA, 201 bp, Homo sapiens; identical to SEQ ID NO: 8806

SEQ ID NO: 33348 - DNA, 201 bp, Homo sapiens; identical to SEQ ID NO: 8807

SEQ ID NO: 33349 - DNA, 201 bp, Homo sapiens; identical to SEQ ID NO: 8808

SEQ ID NO: 33350 - DNA, 201 bp, Homo sapiens; identical to SEQ ID NO: 8809

SEQ ID NO: 33351 - DNA, 201 bp, Homo sapiens
gcaaccaaagggagcataactctgataagaataataaaaagaaacaattcagcaactctcttacagatttttatcatcatcccattcataattgattccaracgtgcatgaatctttcaagataagtgtcttattgattatcctgaaaacaagcgatcacttggtgtcctgagattcgctcactgccctcccctgattacc

SEQ ID NO: 33352 - DNA, 201 bp, Homo sapiens; identical to SEQ ID NO: 14926

SEQ ID NO: 33353 - DNA, 201 bp, Homo sapiens
cctttgcttgttaccagaagagtcgcccagttgtggcagagatcatctagctcgcaaaactgtaaatatttactctttggcctttcccagaaaaaagtgcsgactgctatgttagatactccagttcattcaaagtgatatcaccctaacattctctaaattagccacagcttagatgaaatttaggcaaatggaatgccc

SEQ ID NO: 33354 - DNA, 201 bp, Homo sapiens
gtgccgactgctatgttagatactccagttcattcaaagtgatatcaccctaacattctctaaattagccacagcttagatgaaatttaggcaaatggaaygccccaggccccaggaagactgtggcagcacattgtatgtaactgttggggatgttgcctgaaaccccccccttttttttaggcagctgcaaggattaga

SEQ ID NO: 33355 - DNA, 201 bp, Homo sapiens; identical to SEQ ID NO: 14927

SEQ ID NO: 33356 - DNA, 201 bp, Homo sapiens; identical to SEQ ID NO: 14928

SEQ ID NO: 33357 - DNA, 201 bp, Homo sapiens; identical to SEQ ID NO: 14929

SEQ ID NO: 33358 - DNA, 201 bp, Homo sapiens; identical to SEQ ID NO: 14930

SEQ ID NO: 33359 - DNA, 201 bp, Homo sapiens
tgtcgggccatttgttttttaacgaattgccctttcatcttatatgcatgactattggatatgtatcgattactaattgattgcttgcctcatgtgctatmatttaattttcaaaatgtcccttagaagttaatttataaagtgtctattactttaagtacctgttcaatcctgtgatcaagaggaaattcacagagaaag

SEQ ID NO: 33360 - DNA, 201 bp, Homo sapiens
tggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgccca

SEQ ID NO: 33361 - DNA, 201 bp, Homo sapiens
acagcttctggcgccgcaaacaccttgggtcctagagaaacctgcacacttgtgtctccacctttttacctcttgcgggcatgagtctggtctcagtaatmacattgtccagcccatcataaagggctcttgaacacattttcatcaactttaggttaagtctgtttgggtaaatgcgtcttggagggctgggtagaagat

SEQ ID NO: 33362 - DNA, 201 bp, Homo sapiens
tggagcacttgaaaactgctgttttgtgtcagtaggtaaacaacaaacattggtgactactgaattttcagcagatgtgattcctttgtttcacagaaaawctgtatcttttgttctaaatttttttcttctaatgggtataatcctctgttggagagtcctttgatagctaggagtgtgttttcttctttactttcccaa

SEQ ID NO: 33363 - DNA, 201 bp, Homo sapiens
tgaaaactgctgttttgtgtcagtaggtaaacaacaaacattggtgactactgaattttcagcagatgtgattcctttgtttcacagaaaaactgtatctkttgttctaaatttttttcttctaatgggtataatcctctgttggagagtcctttgatagctaggagtgtgttttcttctttactttcccaaagacaattt

SEQ ID NO: 33364 - DNA, 201 bp, Homo sapiens
gaaaactgctgttttgtgtcagtaggtaaacaacaaacattggtgactactgaattttcagcagatgtgattcctttgtttcacagaaaaactgtatcttwtgttctaaatttttttcttctaatgggtataatcctctgttggagagtcctttgatagctaggagtgtgttttcttctttactttcccaaagacaatttt

SEQ ID NO: 33365 - DNA, 201 bp, Homo sapiens
tactgtggttacatttggaagtgtttacaaaggtgataagatgtttttatagtttggtgttcatttatcgaccatattaagaaccttcttctatgaaatgsttttagtaggaagtattttgaatgaagaaagcgtattttccacaatatatttggtagattatttttcaaaaccaaaggacttcaaaaatgtcttcctatt

SEQ ID NO: 33366 - DNA, 201 bp, Homo sapiens
ggaagtgtttacaaaggtgataagatgtttttatagtttggtgttcatttatcgaccatattaagaaccttcttctatgaaatggttttagtaggaagtaytttgaatgaagaaagcgtattttccacaatatatttggtagattatttttcaaaaccaaaggacttcaaaaatgtcttcctattagtggacaccagtatt

SEQ ID NO: 33367 - DNA, 201 bp, Homo sapiens
ctgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaac

SEQ ID NO: 33368 - DNA, 201 bp, Homo sapiens
acagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttat

SEQ ID NO: 33369 - DNA, 201 bp, Homo sapiens
acatacttcttcctgccctggattaacattaccattggttttagtagtcttacgtcattatgtccaaagcttttaagtttacagtgcttgcttagtccagygaccaatggatgtaagtaagttggaaaagggcaaaggatttagaatcatgagggttgtattcaaactgcagcctctactcccttttagttacataatttt

SEQ ID NO: 33370 - DNA, 201 bp, Homo sapiens
ccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaaagaataaaaatgaataaaaatta

SEQ ID NO: 33371 - DNA, 201 bp, Homo sapiens
acttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgg

SEQ ID NO: 33372 - DNA, 201 bp, Homo sapiens
aaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttatt

SEQ ID NO: 33373 - DNA, 201 bp, Homo sapiens
aagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgcttt

SEQ ID NO: 33374 - DNA, 201 bp, Homo sapiens
ggggtttcaccatgttagccaggatggtctcgatctcctgacctcatgatctgtcagcctcagcctcctaaagtgctgggattacaggcgtgagccactgygcccggccggggatcttgtattaatagtagggagacagtaagcaagcaaggctcagttaatgataaattgttatcaggagacccagcagtttctgctttt

SEQ ID NO: 33375 - DNA, 201 bp, Homo sapiens
gatcacacagctagatcacagtgggggaacctgaattatggggatgctcacaaaagggcaaaacacaacggttgctgtcatttgatgctttatgttaagtrtgcatatgctcagttacagaaacctaaattgctaaattgcaaggctgtatatgatatgccaatttggcatattctgtctttttatattctgccaccccta

SEQ ID NO: 33376 - DNA, 201 bp, Homo sapiens
cacagtgggggaacctgaattatggggatgctcacaaaagggcaaaacacaacggttgctgtcatttgatgctttatgttaagtatgcatatgctcagttrcagaaacctaaattgctaaattgcaaggctgtatatgatatgccaatttggcatattctgtctttttatattctgccacccctatcatacttatgaaaat

SEQ ID NO: 33377 - DNA, 201 bp, Homo sapiens
gctccaggtaaccactcatctactttctgtctctatatagatttgcctattctagacttttcatataaataaatcagatactgtgtggccctttgtgtctygatccttacacttagcatcatgttttcaagggtcattcatgttgtagcatgtatcagtacttctttttttagggctgagtaatattccatttacggatat

SEQ ID NO: 33378 - DNA, 201 bp, Homo sapiens
ggaatgcagtggcacgatgttggctcactgcaaaccctgcctcccaggttcaagcgattctcctctcccagcctcccgagtctctgggattacagacgtgyatcaccaggcccagctaatttttatatttttactcgagacgtagtttcaccatgttggccaggctggtctcaaactcgtgaccttaggtgatatgcgccc

SEQ ID NO: 33379 - DNA, 201 bp, Homo sapiens
tcaagcgattctcctctcccagcctcccgagtctctgggattacagacgtgcatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccag

SEQ ID NO: 33380 - DNA, 201 bp, Homo sapiens
tgatgatccagagctttggagtcagcgagacagtagagagtggtggagatggtggcgcacaagagggtcagtgccccatctcaaggaacagctgcacctcrgcctacgcgattgtgaaaatgtgagcatatgcaggccagaccttggcttctctgtcttcatttttcacaggagccagaagtttggatgtgcaatgtgaaa

SEQ ID NO: 33381 - DNA, 201 bp, Homo sapiens
tccagagctttggagtcagcgagacagtagagagtggtggagatggtggcgcacaagagggtcagtgccccatctcaaggaacagctgcacctcggcctaygcgattgtgaaaatgtgagcatatgcaggccagaccttggcttctctgtcttcatttttcacaggagccagaagtttggatgtgcaatgtgaaatctcac

SEQ ID NO: 33382 - DNA, 201 bp, Homo sapiens
caggagccagaagtttggatgtgcaatgtgaaatctcacaaattaaacatgttacataactgtattttgtttcctatctctgctgtaataaattttctcawtgttagtgacttagaaccacacaaaagttacactttacagttttggaggtcagtggtccaaaataggtctcagtgggctaaaatcgatgtgtcagcagga

SEQ ID NO: 33383 - DNA, 201 bp, Homo sapiens
cccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgggataatctgcctatttgaaggtcagccaattagcaatcttaatgcca

SEQ ID NO: 33384 - DNA, 201 bp, Homo sapiens
tgctcaagtccttctcaaactgccctgttcctggttctctctcttctgcttctgcttttaaggaaccttgtaacttcagggagtctaccctgataatctgsgataatctgcctatttgaaggtcagccaattagcaatcttaatgccatctacaaccttaattaccatttgctatgtaacatatttatagatatcagggat

SEQ ID NO: 33385 - DNA, 201 bp, Homo sapiens
ctcaaactgccctgttcctggttctctctcttctgcttctgcttttaaggaaccttgtaacttcagggagtctaccctgataatctgggataatctgcctrtttgaaggtcagccaattagcaatcttaatgccatctacaaccttaattaccatttgctatgtaacatatttatagatatcagggattagttcatgaaca

SEQ ID NO: 33386 - DNA, 201 bp, Homo sapiens
ttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtctttattttatgtccttggagtgtatagcaga

SEQ ID NO: 33387 - DNA, 201 bp, Homo sapiens
tggtggtgcatgcctataatcccaacacttttggaggccaaggtgaggagaccacctgaggtcaggaattcaagactactgggcaacatggtgaagctctstctatcctaaaaatgcaaaaattagccgggagtggtggtgcatgtctgtagtcacagctacttgggaggctgaggcaggcgaactgcttgaacctgggag

SEQ ID NO: 33388 - DNA, 201 bp, Homo sapiens
ctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaa

SEQ ID NO: 33389 - DNA, 201 bp, Homo sapiens
ccagtcactctatagtaactattaggaaacccctttttttctctgaagtcattgctcctgtgtgtgtgtgtctgtatataaaaaaaagtatgtatacatayacgtatatgtatgtgtatagataaaaatgcatgtatggtgctgggcgcagtggctcacgcctgtaatcccagcactttgggaggctgaggcgggcgaatc

SEQ ID NO: 33390 - DNA, 201 bp, Homo sapiens
gtgtgtgtgtctgtatataaaaaaaagtatgtatacatatacgtatatgtatgtgtatagataaaaatgcatgtatggtgctgggcgcagtggctcacgcytgtaatcccagcactttgggaggctgaggcgggcgaatcacgaggtcaggagatcgagaccatcctggctaacacggtgaaaccgtgtctctactaaaag

SEQ ID NO: 33391 - DNA, 201 bp, Homo sapiens
tgctgggcgcagtggctcacgcctgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccgaagaattacttg

SEQ ID NO: 33392 - DNA, 201 bp, Homo sapiens
tggctaacacggtgaaaccgtgtctctactaaaagtacaaaaaattagcctggcgtggtggcgggcacctgtagtcccagctactcgggaggctgagaccsaagaattacttgatgaaacatggcagacgacatagaccagcagcaaactaccaacactgtggaggaccccctggatcttaggctcagcccagaggagcga

SEQ ID NO: 33393 - DNA, 201 bp, Homo sapiens
tgtagtcccagctactcgggaggctgagaccgaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaat

SEQ ID NO: 33394 - DNA, 201 bp, Homo sapiens
tactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaaggtgcaagatattcaaaaga

SEQ ID NO: 33395 - DNA, 201 bp, Homo sapiens
taagtgtgtaagcagggaacagaaagtactgtgatttaaaatatgttaatttttctactgtacagatgagagccagcttggagatgggctgtagctcaagyatcttacctacctctgatttcttaatgccacgttataaggctgctgcttatagctcttgaagtcactccaaaaacagatgagtgagaccctgttgctaaa

SEQ ID NO: 33396 - DNA, 201 bp, Homo sapiens
agaaaggaagagtttcctgagtcacctttgggaggtaggaagggtttgacatgtaggctgggcatctgggaacgagtgagggattctgtgagccccatctyagtggaccactcaaggaaggtgggtaagccctgggtataagtgtgtaagcagggaacagaaagtactgtgatttaaaatatgttaatttttctactgtac

SEQ ID NO: 33397 - DNA, 201 bp, Homo sapiens
tgtgtcattccgttgtgcctgtcgtcttgaccttgtaaaaggtcttgggtaagcatgcaagaagttttgaagagggagatacagctaatttgcagataaaragcaagggaagaattcctggagaaaggaagagtttcctgagtcacctttgggaggtaggaagggtttgacatgtaggctgggcatctgggaacgagtgag

SEQ ID NO: 33398 - DNA, 201 bp, Homo sapiens
acttgtgtcattccgttgtgcctgtcgtcttgaccttgtaaaaggtcttgggtaagcatgcaagaagttttgaagagggagatacagctaatttgcagatraagagcaagggaagaattcctggagaaaggaagagtttcctgagtcacctttgggaggtaggaagggtttgacatgtaggctgggcatctgggaacgagt

SEQ ID NO: 33399 - DNA, 201 bp, Homo sapiens
ttgttattgtaaaagcatcatgcaccaggtaaaatgtttaataacacagagaaatctaattgtcaagtatcttctcaacacacattaatcaacaattctcmtatcgaaggataacctcttgtatttacaaaaaaaagaagaaaaagtgctgtcatcagtaaattcattcatgtatgttatacacttacatacaaaatgtat

SEQ ID NO: 33400 - DNA, 201 bp, Homo sapiens
atcatacccattcccaagatttcagtcatcaaatccattccaatatgactcctgtatccatatgtccagttccaagtatctgtccatggtgttggtcccakgttattcgcacctcatatgtctttggcacagcactcttgacagctcataaagtcacgctgttacccccacaatgtccccccacatatcattgctatccct

SEQ ID NO: 33401 - DNA, 201 bp, Homo sapiens
gtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatga

SEQ ID NO: 33402 - DNA, 201 bp, Homo sapiens
gcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtc

SEQ ID NO: 33403 - DNA, 201 bp, Homo sapiens
cgcctgccttggccttccaaagtgctgggatatacattttttttttttttttgagagatggagtgtcactctgttgccgaggctggagtgtagtggcgcartctcggctcactgcaacctcctcctccggggttcaagcgattctcctgcctcagcctccccagtagctgggattacagtcgtgtgccaccacgcctggtt

SEQ ID NO: 33404 - DNA, 201 bp, Homo sapiens
gcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataatt

SEQ ID NO: 33405 - DNA, 201 bp, Homo sapiens
agtgagctgagatggcaccactgcactccagcctgggcaatggagcaagactctatctaccccccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcat

SEQ ID NO: 33406 - DNA, 201 bp, Homo sapiens
accacaagcattatcttctttaatcatctcacaatcttatgaaggagatactaatattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggc

SEQ ID NO: 33407 - DNA, 201 bp, Homo sapiens
tactctcctgatagccactaaagggggaattggatattgtctatcaattggttggtctctgaactaaggctgtatctaattacaaggcattgtatcggttstgatttattaaccatttacttggctttggagaaggcagcatttttagtagtactgttgagcctgcatgtagcttttccaggagggcagggtgcctggata

SEQ ID NO: 33408 - DNA, 201 bp, Homo sapiens
tgaagatgctgaggttgagggaagaaataaatgttaatgcaaagtgcccagtttagtgcctgccaagagtaactggtgggtctgtgtcaccttctgacatkatcagtgtgattgtctccaacgcatccatggaagtgaaaccgttggaggaagctaatgccgtgagccagctgttggttatgtttttgttttgtttttctt

SEQ ID NO: 33409 - DNA, 201 bp, Homo sapiens
taaatgttaatgcaaagtgcccagtttagtgcctgccaagagtaactggtgggtctgtgtcaccttctgacatgatcagtgtgattgtctccaacgcatcyatggaagtgaaaccgttggaggaagctaatgccgtgagccagctgttggttatgtttttgttttgtttttcttttttacttgctggatagtgggttctgt

SEQ ID NO: 33410 - DNA, 201 bp, Homo sapiens
atgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgac

SEQ ID NO: 33411 - DNA, 201 bp, Homo sapiens
gcctatcatataggaatgatagaggcagcacagtgctgtaatggaaaccataagggcacgcacaatggctcatgcctgtaatcccagcactttgggaggcmgaggcgggaggatcacataagaccaggagtttgagaccagcctggccaacatggtgaaaccccatctctactaaaactacaaaaatagccaggtgtcctg

SEQ ID NO: 33412 - DNA, 201 bp, Homo sapiens
cataagaccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagaca

SEQ ID NO: 33413 - DNA, 201 bp, Homo sapiens
tgttttaaacccatctgtttttgtttctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccag

SEQ ID NO: 33414 - DNA, 201 bp, Homo sapiens
gtctaatttatgtaaaataaattgcatccatttaaatatacaattcaatgagttttgacagatgcacatgcccatgaaaccaacacgaaaataaaaaaaawagaacatttacgtcacctcaaaaagatttcaaatgccacttctgtggtgtatgactctgagtccagacagcctcagctccaggaaaaccctggtctgttt

SEQ ID NO: 33415 - DNA, 201 bp, Homo sapiens
tttgatattttttaaaggaaaaatttgaggcattgacacatgccttttgcttacttgcttggattggtttgatcaactttgttgcggtctaatttatgtawaataaattgcatccatttaaatatacaattcaatgagttttgacagatgcacatgcccatgaaaccaacacgaaaataaaaaaaatagaacatttacgtc

SEQ ID NO: 33416 - DNA, 201 bp, Homo sapiens
aaaaaagtaaaataaagcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttacttgcttggattggtttgatca

SEQ ID NO: 33417 - DNA, 201 bp, Homo sapiens
aaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaagcagagtgggccattt

SEQ ID NO: 33418 - DNA, 201 bp, Homo sapiens
ccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccct

SEQ ID NO: 33419 - DNA, 201 bp, Homo sapiens
ccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatca

SEQ ID NO: 33420 - DNA, 201 bp, Homo sapiens
cctgtaggtttagcagaatcccagcctcacatcctccccgaacttggcagtaaaagccctgttcttccattcattccgatgatttatattctctctgggcrtcttatattaaacaggggaattccgacatgttccataacacatttactgtaacttgataccatgaactacacttgctgttatttatcatttctttttatt

SEQ ID NO: 33421 - DNA, 201 bp, Homo sapiens
aggctcagttaatgataaattgttatcaggagacccagcagtttctgctttttctaccctcctctttgacctctatttaaactaataggttactgggtttsaacatgccatgcagtgggaagaggcgggaaccccactgagctgtcctctaagtgaatcatgcccactatttggttgtgaggctgtggactttacttttca

SEQ ID NO: 33422 - DNA, 201 bp, Homo sapiens
gtattaatagtagggagacagtaagcaagcaaggctcagttaatgataaattgttatcaggagacccagcagtttctgctttttctaccctcctctttgasctctatttaaactaataggttactgggtttcaacatgccatgcagtgggaagaggcgggaaccccactgagctgtcctctaagtgaatcatgcccactat

SEQ ID NO: 33423 - DNA, 201 bp, Homo sapiens
tctcgatctcctgacctcatgatctgtcagcctcagcctcctaaagtgctgggattacaggcgtgagccactgcgcccggccggggatcttgtattaatartagggagacagtaagcaagcaaggctcagttaatgataaattgttatcaggagacccagcagtttctgctttttctaccctcctctttgacctctattta

SEQ ID NO: 33424 - DNA, 201 bp, Homo sapiens; identical to SEQ ID NO: 8810

SEQ ID NO: 33425 - DNA, 201 bp, Homo sapiens
ctcttctttttttttttttttaaaggagtttcaagggtaagatctgctgtcttgtgaatgtcaaagaagtttctcattcgcccctttcttctctctcccastgtctttaatttgttaatgctttcgacttattttgctttggataattttcaaagtactgctttctctagagatctctaaaaggcagaagttctggctatt

SEQ ID NO: 33426 - DNA, 201 bp, Homo sapiens
tgttaatttagtcagacgaggaaggaaacgagaaaagttattcctatttcatccatctaagactttatatcccatttcaggctgattaaaaggcaaaatcktcacagtaggacaccaaaccctctgtatgccctgcctgcctccccccctctgacccgcctgcctcccccctgtgagctttttccacctactggcctcttg

SEQ ID NO: 33427 - DNA, 201 bp, Homo sapiens
cagttttcagaccaactccattgttactagatatcctgacactgaagaagctaaaaccaaacaacaatgacaacaacaaacccaagtctgccttatggcasattcttcacgtcgtaacaccttccttgggaccctatttctcagtatggacctgactctcccagggatcctagaatgcaagcatagtgattgcaaaccaga

SEQ ID NO: 33428 - DNA, 201 bp, Homo sapiens
ttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttc

SEQ ID NO: 33429 - DNA, 201 bp, Homo sapiens
tagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactcccattttcattcattgattctgtta

SEQ ID NO: 33430 - DNA, 201 bp, Homo sapiens
ccaagagtacacacaggcctgatcgccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcgg

SEQ ID NO: 33431 - DNA, 201 bp, Homo sapiens
ttaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaa

SEQ ID NO: 33432 - DNA, 201 bp, Homo sapiens
tatatattttgaggtataaaaagtacgtgctcaaggtattggtcactcctcaatttgttttccttgaaacaaaatgaaggtataaatatttcagccgggcrcggtggctcacgcctgtaatcccagcactttgagaggccgaggcgggtggatcatgaggtcaggagatcgagaccatcctggctaacaaggtgaaacccc

SEQ ID NO: 33433 - DNA, 201 bp, Homo sapiens
agagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcg

SEQ ID NO: 33434 - DNA, 201 bp, Homo sapiens
ttttttgaggtggaatctccttctgtctcccaggctggaatgcagtggcattttctcggctcactgcagcctccgcctcccaagttcaagccattctccartctcagcctcctcagtggctgggattacaggcatgtgctactacccccggcaaacttttatatttttagtagagacagagttttgccatgttcaccaggc

SEQ ID NO: 33435 - DNA, 201 bp, Homo sapiens
tccttctgtctcccaggctggaatgcagtggcattttctcggctcactgcagcctccgcctcccaagttcaagccattctccagtctcagcctcctcagtrgctgggattacaggcatgtgctactacccccggcaaacttttatatttttagtagagacagagttttgccatgttcaccaggctggacatgaacttctga

SEQ ID NO: 33436 - DNA, 201 bp, Homo sapiens
tggcattttctcggctcactgcagcctccgcctcccaagttcaagccattctccagtctcagcctcctcagtggctgggattacaggcatgtgctactacmcccggcaaacttttatatttttagtagagacagagttttgccatgttcaccaggctggacatgaacttctgacctcaagggatccacctaccttggcctc

SEQ ID NO: 33437 - DNA, 201 bp, Homo sapiens
gtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctg

SEQ ID NO: 33438 - DNA, 201 bp, Homo sapiens
ttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtg

SEQ ID NO: 33439 - DNA, 201 bp, Homo sapiens
gaaaatccttggggagccgccatcattccttccacgaaggaatgaaattataacgtaatgtattgttggagcccttagttcaacactgtcttttttcaggycatattaatgcaatggttagcatatcaacttccttctgtttttagtgactctaatacattatattcaccttgttctctgcatgttctttctttaagtcat

SEQ ID NO: 33440 - DNA, 201 bp, Homo sapiens
gggagccgccatcattccttccacgaaggaatgaaattataacgtaatgtattgttggagcccttagttcaacactgtcttttttcaggtcatattaatgsaatggttagcatatcaacttccttctgtttttagtgactctaatacattatattcaccttgttctctgcatgttctttctttaagtcatgttagatccct

SEQ ID NO: 33441 - DNA, 201 bp, Homo sapiens
tgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgatt

SEQ ID NO: 33442 - DNA, 201 bp, Homo sapiens
tttctaaaactttaagtttcagggtacatgtgtaagatgtgcaagtttgttacataggtaatcatctgccacggtggtttgctgcagagatcaacttatcrcctggatatgaagcccagcgtccattagctgttgttgctgatgctcttcccaccacctgcaagccccagtgtgtgttatccgcctccaccgtgtgtccat

SEQ ID NO: 33443 - DNA, 201 bp, Homo sapiens
agacatagaaattcttgggctttattccacacataatgaatcagaagcttatggggtggggcctgcagtctgacgtttattttttctaaaactttaagttycagggtacatgtgtaagatgtgcaagtttgttacataggtaatcatctgccacggtggtttgctgcagagatcaacttatcacctggatatgaagcccag

SEQ ID NO: 33444 - DNA, 201 bp, Homo sapiens
ttttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggt

SEQ ID NO: 33445 - DNA, 201 bp, Homo sapiens
ggagaggtgcgatttccctccacataatcttcagttagtgatctctgtaagagaatgtttttcaaaaggctaatagagaagtaatgagatcagaaggaggycaacccggccttctccgtttggcagcttgattaatttatttctccttcttggagattgctgcaaggggcttttgtcaccctgtgtttttcatgggactgt

SEQ ID NO: 33446 - DNA, 201 bp, Homo sapiens
agcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttc

SEQ ID NO: 33447 - DNA, 201 bp, Homo sapiens
taactgggtgtggctgtgtcctaataaaactttatttacaaagaacaggaagtggcttggatttggtatctggcctggcagctgtggtttactactccttrgacggtggcccagagaccctttaaatgaaattcattttactagcaccctttttcatcatgagaaatatattctgtttttcttagaaaatgggttatgtta

SEQ ID NO: 33448 - DNA, 201 bp, Homo sapiens
ttacaaagaacaggaagtggcttggatttggtatctggcctggcagctgtggtttactactccttagacggtggcccagagaccctttaaatgaaattcaktttactagcaccctttttcatcatgagaaatatattctgtttttcttagaaaatgggttatgttaggtctggtcaaggtaaataagtgttgagagtcgat

SEQ ID NO: 33449 - DNA, 201 bp, Homo sapiens
tctgtttttcttagaaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggt

SEQ ID NO: 33450 - DNA, 201 bp, Homo sapiens
atataatgatgataataattgctaatatttatcagctatttatcatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacct

SEQ ID NO: 33451 - DNA, 201 bp, Homo sapiens
atctgtaaagtaaaaataaccgtcgtcgtcatttctcaagcgtgacgatactgttacacgtttactgcatattctgcataccaagcacatatccgtcacaygcagtgtggccaacttccgagaggccggcattcagccaaacagcctgaagaaccaggagaaatgcctgagtttccaaatggcttatggtaagttgttgct

SEQ ID NO: 33452 - DNA, 201 bp, Homo sapiens
ggtgcccgccaccaggcctggctaattttttttgtattattagtagagatggggtttcaccgtgttagccaggatggtcttgatctcctgtccttgtggtycgtctgcctcggcctcccaaagtgctaagattacaggcacgagtctccgcacccggccctgtttttgcatttttagtagagacgggttttcaccaggttg

SEQ ID NO: 33453 - DNA, 201 bp, Homo sapiens
agtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaat

SEQ ID NO: 33454 - DNA, 201 bp, Homo sapiens
agggtcattcatgttgtagcatgtatcagtacttctttttttagggctgagtaatattccatttacggatatgccacatttcatctatgcattcagttcayggacatgtgggttgtttccacattttggctattgtgcataatgcttccaggtacacttgtctacacatttttgtgtggatataggttttccttttttggg

SEQ ID NO: 33455 - DNA, 201 bp, Homo sapiens
ttcttaaccctttaagaaatatgacttgttctaattgccttttcttatttacattatacttaggctggtgttaggatgccgtggctgccaagtttacacartgcactttctctctctctttcttcttttggtttatgatgtttttcaatagtgtcatggaactcacttaatctgatttcatcaagtaaatatatgggaagt

SEQ ID NO: 33456 - DNA, 201 bp, Homo sapiens; identical to SEQ ID NO: 8811

SEQ ID NO: 33457 - DNA, 201 bp, Homo sapiens; identical to SEQ ID NO: 8812

SEQ ID NO: 33458 - DNA, 201 bp, Homo sapiens; identical to SEQ ID NO: 8813

SEQ ID NO: 33459 - DNA, 201 bp, Homo sapiens
tttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagcta

SEQ ID NO: 33460 - DNA, 201 bp, Homo sapiens
tgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatc

SEQ ID NO: 33461 - DNA, 201 bp, Homo sapiens
ttggccattgcccactaagaaaatttaggtggtttttattgggattagtggatgaacttaggattagtgtggcccttccttgagatataatgacaaccttsgtgaaagcaagaccacagggcctatcttcagggaagtgccttgcattttaataccaaccatgccacgtgtatgtgtttcctgggcctgccataacaaatt

SEQ ID NO: 33462 - DNA, 201 bp, Homo sapiens
tggccattgcccactaagaaaatttaggtggtttttattgggattagtggatgaacttaggattagtgtggcccttccttgagatataatgacaaccttgstgaaagcaagaccacagggcctatcttcagggaagtgccttgcattttaataccaaccatgccacgtgtatgtgtttcctgggcctgccataacaaatta

SEQ ID NO: 33463 - DNA, 201 bp, Homo sapiens
ccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttgg

SEQ ID NO: 33464 - DNA, 201 bp, Homo sapiens
aattatgtagtgtctacagagccagtggtttattttgcattgtttatgtcagcattaagcagtattcttacacagtttgtaagtcttaaaactcagtatckactctagtagttgctccaaatgtgatgtcctcataaatcaccgagggatcttgttaaatttggattctgattcagtaggtctaggtggggcccgagcttc

SEQ ID NO: 33465 - DNA, 201 bp, Homo sapiens
ttttaagatacagaaagtgggccttaaaggtgctactgacttgctgatatgctttggctgtgtccccacccaaatcttaacttgaatcgtatctcccagarttcccacgtgttgtgggagggacccagggagaggtaattgaatcatgggggctggtgtttcccatgttattcttatgaaagtgaataagtttcataagat

SEQ ID NO: 33466 - DNA, 201 bp, Homo sapiens
tttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcc

SEQ ID NO: 33467 - DNA, 201 bp, Homo sapiens; identical to SEQ ID NO: 27136

SEQ ID NO: 33468 - DNA, 201 bp, Homo sapiens
tggtttactactccttagacggtggcccagagaccctttaaatgaaattcattttactagcaccctttttcatcatgagaaatatattctgtttttcttaraaaatgggttatgttaggtctggtcaaggtaaataagtgttgagagtcgatgttgtgtgcatagttaatttcaattctttgaagaagctcccccatgata

SEQ ID NO: 33469 - DNA, 201 bp, Homo sapiens; identical to SEQ ID NO: 8814

SEQ ID NO: 33470 - DNA, 201 bp, Homo sapiens
cccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctca

SEQ ID NO: 33471 - DNA, 201 bp, Homo sapiens; identical to SEQ ID NO: 8815

SEQ ID NO: 33472 - DNA, 201 bp, Homo sapiens
atccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtgg

SEQ ID NO: 33473 - DNA, 201 bp, Homo sapiens
ttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctcgctcctggggcaggtgcctctgggggtctctgccaggc

SEQ ID NO: 33474 - DNA, 201 bp, Homo sapiens
tcccgctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtga

SEQ ID NO: 33475 - DNA, 201 bp, Homo sapiens
ccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacagggagacagtaagaaaggtgacgtcaatctgagatgagagagagagcaaaacag

SEQ ID NO: 33476 - DNA, 201 bp, Homo sapiens
ccgggaagagcgcatcctaaatcagccattagatttgttcctcatttctttgctttacaaattgtttttctgtatagtattggattttcaataaataaagkatgatataaacaagtctgcaaaccagcaagaactatataagccacttgctcaagtcaataagcgcatgctcacaaaggaacgtaaagttctgaagttctt

SEQ ID NO: 33477 - DNA, 201 bp, Homo sapiens
aatttcatcactccaaaaagaaatctcataacaattagcagttattttccatcgctacttcctccagtcccaaggcaatcagcagtctgctttctatctcyacctgtttgcctattctggacatttcatatgagtggagttagataatacatggccttttgtgactggctttcacttagcataatgttctagaggttcatt

SEQ ID NO: 33478 - DNA, 201 bp, Homo sapiens
tggtattggtacaatcagtcaggaagcatttttcctggggagaaacttacaagtccacgatcaaagccaacaagagacaaggtgttacatgactcattttyggtttaagaagtgacaggctgattctaagttgggttcaattattttgttaaagcgttttgcttatttgacttctcctgacctcggaaataattctaacca

SEQ ID NO: 33479 - DNA, 201 bp, Homo sapiens
accctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaag

SEQ ID NO: 33480 - DNA, 201 bp, Homo sapiens
cttttctgactgctcaaaacagggaataataaacagtcagagtgtccaagtaatctgagctagaaagttccttctttcagagaaaagttataaaaagtatwtttgccggatccaaaaaaaatactgtgtatcaactactgagacctgcataatgttttcttagtattctcactctttaaaagaaaaaagaaaacctgtaaa

SEQ ID NO: 33481 - DNA, 201 bp, Homo sapiens
tcagagtgtccaagtaatctgagctagaaagttccttctttcagagaaaagttataaaaagtatatttgccggatccaaaaaaaatactgtgtatcaactmctgagacctgcataatgttttcttagtattctcactctttaaaagaaaaaagaaaacctgtaaaatttgggaacttaaactttttttgatattttaatat

SEQ ID NO: 33482 - DNA, 201 bp, Homo sapiens
tttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctcc

SEQ ID NO: 33483 - DNA, 201 bp, Homo sapiens
agagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatgga

SEQ ID NO: 33484 - DNA, 201 bp, Homo sapiens
ccactttttaaacatgacattcgatccacgtggcatagcaaggatgggatccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataa

SEQ ID NO: 33485 - DNA, 201 bp, Homo sapiens
tgacagggagatggagggaggcaaaaagaaaaagggagaaggaaagagaggaaagaggggaagggaggaaggaaagaagagagagaaggaggaagagaggraaggaggcacagaggtagagaggcagggagataatggagatcctggccaaaagttaatgctccgtttctagtagtccacagaaagcaccttgaccaagtg

SEQ ID NO: 33486 - DNA, 201 bp, Homo sapiens
gctatgtcagaagcaagtcaggatttgaaggcagatctgtctgcttttgcccctctgtaaatccagagctgctgcctcatttcttacgttgcccccacccrtgcagcaattcttcctgggaggcctcattgttcatattcataaagggccccattcagtctcctttttggagaaatggccactgcaactctctgttctgac

SEQ ID NO: 33487 - DNA, 201 bp, Homo sapiens
ttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggag

SEQ ID NO: 33488 - DNA, 201 bp, Homo sapiens
ccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcat

SEQ ID NO: 33489 - DNA, 201 bp, Homo sapiens
catgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggc

SEQ ID NO: 33490 - DNA, 201 bp, Homo sapiens
tggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcaacaaaggcc

SEQ ID NO: 33491 - DNA, 201 bp, Homo sapiens
ggctccgagaagctcacccatcaccatttgctctactgcaaaacaggactcattagcaggagctcataaaatgaaactggcagtgagctcatatggaagargcatcacgggcaactcggcttggctcaccagcccctgagctgcccccgagtgaccgctccagccttctttccttccacctctccctcttggccaacttca

SEQ ID NO: 33492 - DNA, 201 bp, Homo sapiens
taagtctccattccgcttgccaagattaaattgaattattcccgctgccattcagttttactctgcacaaaatacagccaacatttttgcatttctttctyccttcctccttttcttctttctttccttccttccttcctttctcccttcatctatctttgttccgcttttgtttgtttttttttagatcgctgcatgctg

SEQ ID NO: 33493 - DNA, 201 bp, Homo sapiens
gagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactgg

SEQ ID NO: 33494 - DNA, 201 bp, Homo sapiens
ttccagtttctcaattgcaaaagtgaggctggtcatggggcttggaaccacgccacggacgcatgaagcctccccgtttacatgccaaatccagagcttakgcatccatgctcagggctctctgtggtaggcaacagctggattatttactttctagaatatctcgagttcttaatctgagcagtttcgaaaccaagccca

SEQ ID NO: 33495 - DNA, 201 bp, Homo sapiens
ttctcaattgcaaaagtgaggctggtcatggggcttggaaccacgccacggacgcatgaagcctccccgtttacatgccaaatccagagcttaggcatccrtgctcagggctctctgtggtaggcaacagctggattatttactttctagaatatctcgagttcttaatctgagcagtttcgaaaccaagcccacattaat

SEQ ID NO: 33496 - DNA, 201 bp, Homo sapiens
gagaaggacccggttggctctgcaaaccgcatttccttggctgaacgccagaggagagaaatgatccggcaagaagacacaccattccccgtcagcccctwcccgacccttgcacccctggatcttctgctgagtatcggattggtctgcgtccaagagctcctcgcttggccagcaggggctgcctggagaaggggagga

SEQ ID NO: 33497 - DNA, 201 bp, Homo sapiens
ttctgctgagtatcggattggtctgcgtccaagagctcctcgcttggccagcaggggctgcctggagaaggggaggacaggcttcgagttttttgggtagbgacttctgtggacgtgaaaagactgcaccagaaatcggaggcagccctccaaacataacttggcctcttcgttctccctgtggacacacaggctgtgttc

SEQ ID NO: 33498 - DNA, 201 bp, Homo sapiens
aaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcaga

SEQ ID NO: 33499 - DNA, 201 bp, Homo sapiens
gtaagaggtttgagggaaaaataatactgagttttgagtgtttctgattttaaaaatgtgttgagtagaattaaacgtgttcaccaaaacccattttatcmctttaaattattgggcaattaattgtatttacttagcattgaatgcatgattagaaatggaatttttaaaaaagcaatactcaagtggagtgagttcatt

SEQ ID NO: 33500 - DNA, 201 bp, Homo sapiens
tatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccacgggaaat

SEQ ID NO: 33501 - DNA, 201 bp, Homo sapiens
ttgtcagttcaggagggtagaggataggggggaaaaggtgctactggcatctagtgggcaaaggccagggatagtgctaaggatcctgcagtgcaaaggascatgcccaccacaaaatatcagcagtgccgaggttgggaagctctgtgccattgtgcaaagattcaaggtggctatgtcacaggactggtacatgtcctt

SEQ ID NO: 33502 - DNA, 201 bp, Homo sapiens
tggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggagg

SEQ ID NO: 33503 - DNA, 201 bp, Homo sapiens
tcattatatgcctccaaagactttgtgtttcctgtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtata

SEQ ID NO: 33504 - DNA, 201 bp, Homo sapiens
gatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtct

SEQ ID NO: 33505 - DNA, 201 bp, Homo sapiens
aatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgatt

SEQ ID NO: 33506 - DNA, 201 bp, Homo sapiens
aaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattctt

SEQ ID NO: 33507 - DNA, 201 bp, Homo sapiens
gttgtcacattcttctgcctagagtatgccttttccttcaccaaaccaagtggctctttcggaagacttgcctgaatcctagaccccttctctctacaacmttcagtctgagttgggtaccttgcatcctcctttgttcccatactaacccctacaaccatggtcattttgtggttatctgtttaattctctgctggctat

SEQ ID NO: 33508 - DNA, 201 bp, Homo sapiens
gatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccaggg

SEQ ID NO: 33509 - DNA, 201 bp, Homo sapiens
ccgggaggattttcttttctttttctttttaatcctcctcctcaagggaaacattcttctcacaatagcttcctggtagaaagttctaactaatgactttratcgtgtgaatgtattgcagaaatggacaggacaattctcagcccattcatcttacagacctcaagtgaacaggcacaaaacaacaggctccaccctcct

SEQ ID NO: 33510 - DNA, 201 bp, Homo sapiens
ttttcttttctttttctttttaatcctcctcctcaagggaaacattcttctcacaatagcttcctggtagaaagttctaactaatgactttaatcgtgtgmatgtattgcagaaatggacaggacaattctcagcccattcatcttacagacctcaagtgaacaggcacaaaacaacaggctccaccctccttcccccctc

SEQ ID NO: 33511 - DNA, 201 bp, Homo sapiens
tcctcctcctcaagggaaacattcttctcacaatagcttcctggtagaaagttctaactaatgactttaatcgtgtgaatgtattgcagaaatggacaggrcaattctcagcccattcatcttacagacctcaagtgaacaggcacaaaacaacaggctccaccctccttcccccctctatctcatactttacctcaattt

SEQ ID NO: 33512 - DNA, 201 bp, Homo sapiens
tctcccgtctctgcagttcaggagattatattagaaaatattctatacaaaaaatatgcatagtagggcttttctccagctagtagctcagaataagtcaktactactgaaacaggtaccttttgtggaattgattctgaaatctgtttggatctgaaatctttctttcttgcctttgagtaagatacggcagagaaaaac

SEQ ID NO: 33513 - DNA, 201 bp, Homo sapiens
cccgtctctgcagttcaggagattatattagaaaatattctatacaaaaaatatgcatagtagggcttttctccagctagtagctcagaataagtcagtaytactgaaacaggtaccttttgtggaattgattctgaaatctgtttggatctgaaatctttctttcttgcctttgagtaagatacggcagagaaaaacaat

SEQ ID NO: 33514 - DNA, 201 bp, Homo sapiens
gctcagaataagtcagtactactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtg

SEQ ID NO: 33515 - DNA, 201 bp, Homo sapiens
acttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatcct

SEQ ID NO: 33516 - DNA, 201 bp, Homo sapiens
actgccaagctcattcaggatgctggcaggattcagatccttgaagttgtaagactagggcccctgtttcctactgacttctgctggtggctgccctcagytcccagaggcaacccacattccttgacttttggccccctgcatctcaaagccagcaacagaaactctcttgtgcatggagtcccctcctgctttgaatct

SEQ ID NO: 33517 - DNA, 201 bp, Homo sapiens
atgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagag

SEQ ID NO: 33518 - DNA, 201 bp, Homo sapiens
agtggccctaggatggctcctcagatagctgctggcagaaacctgcactcagtacatctatacatggtgtaatgattgactcaagataattagcatagccrtcatctcaaacctttattatttgtgatgagaagattcaaaacccgctttttgaactgttctgaaatatgcaataccttgttgttaactgtattcaccttt

SEQ ID NO: 33519 - DNA, 201 bp, Homo sapiens
acacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaaca

SEQ ID NO: 33520 - DNA, 201 bp, Homo sapiens
tattcagttgcccagctcttttcattccctgtcctttccccctctggctgggtctgcctttccaaccgctaccaccttccaccaccattttttttttgttkcctctgcaagcaacatctgaaaggcccagacccagcttgttggccttgggctctgataagatctgtctgcactccttttgtctggcctgtacctgccttt

SEQ ID NO: 33521 - DNA, 201 bp, Homo sapiens
tgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccc

SEQ ID NO: 33522 - DNA, 201 bp, Homo sapiens
gattcctccccattctataaaataacagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaaca

SEQ ID NO: 33523 - DNA, 201 bp, Homo sapiens
ctgggactacaggtgggtaccaccatacccagctgttgaaaaaaaaatggtggggtattactctgttgcccaggctggtgttgaactcctggcctcaagcratcctcctgcctcggcctcccaaagtgctgggattacaggcttgagctacttccccaggctcttcccccgtttgttaatacataccatgaccttggcctt

SEQ ID NO: 33524 - DNA, 201 bp, Homo sapiens
aaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccata

SEQ ID NO: 33525 - DNA, 201 bp, Homo sapiens
caccactgtacagcatctttacttaatctgccctctttcacgtgtgtgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcag

SEQ ID NO: 33526 - DNA, 201 bp, Homo sapiens
ttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctacc

SEQ ID NO: 33527 - DNA, 201 bp, Homo sapiens
ttgatgtaaaggactacctgaggctggctaatgtataaagaaaagaggtttaattggctcatggttccgcaggccatacaggaagcccagttagggaggcstaaggaaacttaaaatcatggcagaagatgaaagggaaacaggcatgttctgcatggctggagtaggaggcaaggagcgaaggaggaggtactacccact

SEQ ID NO: 33528 - DNA, 201 bp, Homo sapiens
gaaaagaggtttaattggctcatggttccgcaggccatacaggaagcccagttagggaggcgtaaggaaacttaaaatcatggcagaagatgaaagggaarcaggcatgttctgcatggctggagtaggaggcaaggagcgaaggaggaggtactacccacttttaaacaaccagatctggtgagaactcactcactgtca

SEQ ID NO: 33529 - DNA, 201 bp, Homo sapiens
agttgcacaattcacacaccaggctgccactttggcccctgcgtcaccttcaccaccacccaatgtgtcctgctcatcactgaggtttgtcatttttactytgagtctgtccattgtcatcatctccaccatcaccccttttgttctcattgccacccttgcctggggtgagtgaagacgctcttctctggcttccaccct

SEQ ID NO: 33530 - DNA, 201 bp, Homo sapiens
agaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaa

SEQ ID NO: 33531 - DNA, 201 bp, Homo sapiens
tggtagtagtagtagtgaatgccctgactttggggtttgcagtaagctaggattaagtgcttcacagtgaggcacagtggggagctactctgaggatgaawtgcctagtaaataagtgaggtttgtataaccgaggccagatcttagaacctcctgctatctgtacatagaagaatgttttagtcagaggcaaggcaaggt

SEQ ID NO: 33532 - DNA, 201 bp, Homo sapiens
tgaatgccctgactttggggtttgcagtaagctaggattaagtgcttcacagtgaggcacagtggggagctactctgaggatgaattgcctagtaaataartgaggtttgtataaccgaggccagatcttagaacctcctgctatctgtacatagaagaatgttttagtcagaggcaaggcaaggtcaccaggattcactg

SEQ ID NO: 33533 - DNA, 201 bp, Homo sapiens
gaatgccctgactttggggtttgcagtaagctaggattaagtgcttcacagtgaggcacagtggggagctactctgaggatgaattgcctagtaaataagkgaggtttgtataaccgaggccagatcttagaacctcctgctatctgtacatagaagaatgttttagtcagaggcaaggcaaggtcaccaggattcactga

SEQ ID NO: 33534 - DNA, 201 bp, Homo sapiens
aagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactca

SEQ ID NO: 33535 - DNA, 201 bp, Homo sapiens
aaagggggttaaaagggtttaggggaagtttagttgtcttccttttatctctaactctaaaacccaactgctggctgaattaaaagtctcttacataatgrtcagaggagttttgagtatcggatctttgtgtacttgctttttaaattcagtcacgtcttaaatagtacttttcactctcctcctctccacaccacttta

SEQ ID NO: 33536 - DNA, 201 bp, Homo sapiens
ttccttttatctctaactctaaaacccaactgctggctgaattaaaagtctcttacataatggtcagaggagttttgagtatcggatctttgtgtacttgytttttaaattcagtcacgtcttaaatagtacttttcactctcctcctctccacaccactttatgtgtttgctagtagcttccatgaaactctatgggtga

SEQ ID NO: 33537 - DNA, 201 bp, Homo sapiens
atcagtggttaccaggcagtgttgcattttttccatcccatacctctgtgtgtgttccttatctgtttctaggatgtgccctctgccccgtcacatcacaytctgtgctgctctcagccaaagctcttcttaaatacactagccatcaaaaccatacaacttggctgggtgcggtggctcacacctgtaatcttagcattt

SEQ ID NO: 33538 - DNA, 201 bp, Homo sapiens
atatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgac

SEQ ID NO: 33539 - DNA, 201 bp, Homo sapiens
gaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcacgatctatatctcagttttccttat

SEQ ID NO: 33540 - DNA, 201 bp, Homo sapiens
aaaacttaacaattgtggaagcaatgaattgaaggactagggtcaccagtggagtcccataaataggttgtttatgatccctgtgaaacaagaagaccctyttaatttcatgcttcttaaactggggtatgagtggccccaggtttccctgttgggggtactgataccagagttcatttgaagtcattggaaaccaaggca

SEQ ID NO: 33541 - DNA, 201 bp, Homo sapiens
cccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcg

SEQ ID NO: 33542 - DNA, 201 bp, Homo sapiens
gagggggacatttgggaatggcatttttagtactcacaaggtaactggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacact

SEQ ID NO: 33543 - DNA, 201 bp, Homo sapiens
ggactgtcttagtcagtccaggctgctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagaga

SEQ ID NO: 33544 - DNA, 201 bp, Homo sapiens
gcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgat

SEQ ID NO: 33545 - DNA, 201 bp, Homo sapiens
ccaacacccgacaggcatcttagaaagtggagggtgtaagttataaagagagattacttccaacacgtttctttaaagcctgctggctaaattaggtgggrccttctttgtgtcctctctgttcttgctagtctggcctttgtataatagggaagcagatatatctggaagcctctaagtgtgcatcatggaaattgtttg

SEQ ID NO: 33546 - DNA, 201 bp, Homo sapiens
acccgacaggcatcttagaaagtggagggtgtaagttataaagagagattacttccaacacgtttctttaaagcctgctggctaaattaggtgggaccttmtttgtgtcctctctgttcttgctagtctggcctttgtataatagggaagcagatatatctggaagcctctaagtgtgcatcatggaaattgtttgaaatg

SEQ ID NO: 33547 - DNA, 201 bp, Homo sapiens
ctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtg

SEQ ID NO: 33548 - DNA, 201 bp, Homo sapiens
gtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattca

SEQ ID NO: 33549 - DNA, 201 bp, Homo sapiens
tatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagag

SEQ ID NO: 33550 - DNA, 201 bp, Homo sapiens
cctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatgg

SEQ ID NO: 33551 - DNA, 201 bp, Homo sapiens
tctagaataagtccgtctcacgttacagtgcttaggaagtgttagatgtactgtcatttcttcaacatatatgtcctatattagtctattctcacactgcwagtgaagacatacctgagatggggtaatttgtaaaagaaagaagtttaacggactcatagttgcacatggctggggaggccacacgatcatggcggaagg

SEQ ID NO: 33552 - DNA, 201 bp, Homo sapiens
aatcccagctgctagggaggctgaggcaggagaatcacttcaacccggaaggcggaggtttcagtgagctgagatccagcctgggtgacagagcaagactycatctcaaagcgaaacaaaacaaatgagggtcctcatcagcgtgcctttgacactgtcctctggtcctggtgatctgaatacatcaccacagaactgcca

SEQ ID NO: 33553 - DNA, 201 bp, Homo sapiens
agagcaagactccatctcaaagcgaaacaaaacaaatgagggtcctcatcagcgtgcctttgacactgtcctctggtcctggtgatctgaatacatcaccrcagaactgccagggtacgtgtttcctagcccatagcgagtcccagtgaaagcagagatgagaaagaaaggagggacacaaggtctgggtcctgagttcca

SEQ ID NO: 33554 - DNA, 201 bp, Homo sapiens
tgctggattatctagtccctgaacagccatttatatttttgttacgcttgtggtttttaaatcatcctcatttccttgatcgcatttgcttctcctggctrgaatgtgtaggagacgggtcggggagactgtgcccatttgacaggtgtgaatgcgaacagaggctgcagctggttagaccagggctgtgcaaccctagag

SEQ ID NO: 33555 - DNA, 201 bp, Homo sapiens
gcttgtggtttttaaatcatcctcatttccttgatcgcatttgcttctcctggctagaatgtgtaggagacgggtcggggagactgtgcccatttgacagrtgtgaatgcgaacagaggctgcagctggttagaccagggctgtgcaaccctagagccattgccttgaccacaaagccacagtctcctagtcctaatatta

SEQ ID NO: 33556 - DNA, 201 bp, Homo sapiens
ttaaatcatcctcatttccttgatcgcatttgcttctcctggctagaatgtgtaggagacgggtcggggagactgtgcccatttgacaggtgtgaatgcgracagaggctgcagctggttagaccagggctgtgcaaccctagagccattgccttgaccacaaagccacagtctcctagtcctaatattaagaggtaggag

SEQ ID NO: 33557 - DNA, 201 bp, Homo sapiens
ggagacgggtcggggagactgtgcccatttgacaggtgtgaatgcgaacagaggctgcagctggttagaccagggctgtgcaaccctagagccattgcctygaccacaaagccacagtctcctagtcctaatattaagaggtaggaggtagatagagattgtcccttaagccacattccattcttcatatttttgtaccca

SEQ ID NO: 33558 - DNA, 201 bp, Homo sapiens
gtcactccatagagaggggtttgtggaaatcctttttttttttttttttttttttgcttctttctgtggatctgtttggaaatgtaacattttaaagcccytcttggctggaggattttttatggtaaacataaaacgttcattgaaacattaaacattttacagctgtttttcagcacataaattttcatagacatccac

SEQ ID NO: 33559 - DNA, 201 bp, Homo sapiens
aaaacgttcattgaaacattaaacattttacagctgtttttcagcacataaattttcatagacatccaccccctcactgccacaccccctcatagatttcytcttttcctcctccttctcctcctccctcttcctcctctttttccccccccttcaaatagttccaagaccagagttgagggtgggtgggtagagggctag

SEQ ID NO: 33560 - DNA, 201 bp, Homo sapiens
aaactataatctttctctctgcctcagtttttccacctgtcagtggaggggcatgctcttggatgcctgagtttttcttagactcagcatcctgcagccgmaataaccatgcttcttagtggtcctcttgcgtagcagcctaagaaactccaagtccatctgcgccgaagagtattgaacttggccagagcacttgggatc

SEQ ID NO: 33561 - DNA, 201 bp, Homo sapiens
taattatataaaaaaagcatggaaactgggcattttaattagcaagtacagccttgacacaaataaaggcatggctttggttatgcagtgcatttatttgrttttcttgaaataagaaaaaaagatatcttctccatcaccagagttgctgagtttgacagtgtgaatgagatgacctctaaggcctctacttatagatct

SEQ ID NO: 33562 - DNA, 201 bp, Homo sapiens
tgggcattttaattagcaagtacagccttgacacaaataaaggcatggctttggttatgcagtgcatttatttggttttcttgaaataagaaaaaaagatwtcttctccatcaccagagttgctgagtttgacagtgtgaatgagatgacctctaaggcctctacttatagatctgcacggttgggcctgggagctgtact

SEQ ID NO: 33563 - DNA, 201 bp, Homo sapiens
acagtctgtgctgtgtcctgcactgtccattatctgcaggggtggtactgctgtccccagggaagagaatgctgtccacaaagagccagccatttatactmttaaaagaatacacaggagttgaacaatgagaacacgtggacaacgggaggggggaacatcacacaccggggcctgtctgggggtagggggaaaggggag

SEQ ID NO: 33564 - DNA, 201 bp, Homo sapiens
tttcgagaaggcaatatagaaaatgcagtgggtagcccaggactcctggtccaggtaaagcaggccttgttgctattcccctggaccatgatattacatgytgggatgatggggtcttgtgatactgattaatttaaggctgcatgatgatgagggaggaacaaagatgttcttgagtcagtacctgccagagtggctgta

SEQ ID NO: 33565 - DNA, 201 bp, Homo sapiens
gtctcaagctgctgatttccgggagcaaagctgctgtgggacatgagactctttgaggcagaatacctctcatgcctggagagcattacaggctgcattastctgttttcactctgctgataaagacatacccaagactgtgcaatttacaaaagaaagaggtttaatgaactcacatttccccatgtctggggaggcctc

SEQ ID NO: 33566 - DNA, 201 bp, Homo sapiens
ggcctggtcacatcttctgacctcaagtagtttatagtccaaaaagacattggctctttgggatagaggcactttttgggggagagaaacatgaatgcaaytttttacatagagtatgaaactctgttccaaatctctcaaactcaggttctttgattcttaaggtatttttcactgccgagttgctgtcattgaaacaaa

SEQ ID NO: 33567 - DNA, 201 bp, Homo sapiens
tctctcaaactcaggttctttgattcttaaggtatttttcactgccgagttgctgtcattgaaacaaaatctgtcctggtcaccactgtatgcccagcacstagtacagtgccctgaacatattaggtactcattaaatacttgttccacgaagttgttatttggtattcacgagttttgtctcaattccttttgattctt

SEQ ID NO: 33568 - DNA, 201 bp, Homo sapiens
tgtctgtgtgtgtgtgtgtgtgtgtgtgtgtgtttgaataatactcctatgaacattgtaccaatatctattcagatctctgctttcgattcttctgcatrtatacctaggagtgaaattgctgcgtcgtttcgtatctgtgtgcttaaccttttgagaaactgccaaactgtcttcaacagcagccgcatcattttacat

SEQ ID NO: 33569 - DNA, 201 bp, Homo sapiens
gtggattggtaagggacaggtggtgaagactgaaacagggtatccagttaggaagctaccacagtgatccaacccccagcttctgttgaggttgaagaacmtgcatgcccaacctaaatatatgttcaaaggtggttattactgtttgaggtgatgaaagagttttggagatagaagtgatggttgttcaacatcatgagt

SEQ ID NO: 33570 - DNA, 201 bp, Homo sapiens
agccctttcttgtttagtgttgtgtcttctgtgtcaacatctctggaacatagtcaatggcagtacccagtagaagccatatggatactttttctcaagtsttgaaataaattaatggtgtggccatggttctcgtacttcaggtccctgtgagcccctggggtcctacacaacttggggtaatgctatggtcacctgcat

SEQ ID NO: 33571 - DNA, 201 bp, Homo sapiens
cctggggtcctacacaacttggggtaatgctatggtcacctgcatcccctcctctccagccctcacctggttttctcttctccttccaagaaaaaacaccyataccattcttaacatctctggaagctgggggtcaggagagggagatccataaagttcttgtcttccccgactcaagaagcttaagggtacattcactca

SEQ ID NO: 33572 - DNA, 201 bp, Homo sapiens
tggtaccctgagcaattttaagttataaatatgagatcactgaaagtggagttggggaacacgttattatatagtattttcaccacacacaggatacagtmaatgacttcaagagcataggtaacagtaaaatgtagtaaaacaatttagaagtcatgagttttgagtacttagtactttttagtatgatttatttaatag

SEQ ID NO: 33573 - DNA, 201 bp, Homo sapiens
tgggattacaggtgtgagccaccgtgcccagctcagcattattatttttagtctacacacagtgaacttaaatctcctctagaaaagtcagaaggtctacstacaactttaagagttcagccaaaagagaccagtatctactaccgtggacaaccctatttaacatggaggagataagcagaaactgaaaagaggagcctg

SEQ ID NO: 33574 - DNA, 201 bp, Homo sapiens
ggctattatgtgaagttaggaaatatttaaaactctgcctttctaaagaaacagggacacggtgcagaaaagttcatctggagttaggcttgtgtcttgcygtctctttaacggagagttcatgggcagggtacagtctgtgagaaggaatgaaaaccccagggtagatgctaacaaaaatcacttttaaaaaatgtatgg

SEQ ID NO: 33575 - DNA, 201 bp, Homo sapiens
tggtgtccatctgggttagcaaacacatgctcacacgtctgtgcttgctggatttttaagaacttaccagcatttaagattttcttatgaaactgattttwctcaccagggatagagtctcaaagttggaggtattttatgttgttttaaataatatcgtcatcacatgtcattttagaccccaaaagtccactccgaatc

SEQ ID NO: 33576 - DNA, 201 bp, Homo sapiens
agatctgcgaatatagaaagattaagagtttttttctgccttgttgggtcttctttctagcatgccagcaacatttttctcatcttttgaacattagggamtaacacccaatgccaccctataatctcgagacagaagtggaggatcctcttaagacaagaaatctttcaaagccaaataatgaattaatccaaagccact

SEQ ID NO: 33577 - DNA, 201 bp, Homo sapiens
ctgtctgttttcttttctttcaaatgtttcacttaattccctgatataataaggcttccaaattcttggtgtttttctacaaccaagaccttgaacttttkcctctcaggatttctttcatgagaacccattttctggccatttggatatcattgatgagggaattgaagcatttccctattctttagagtttcattaaag

SEQ ID NO: 33578 - DNA, 201 bp, Homo sapiens
ttccagtaacaattgttgcataacaaaccacccccaaatttagtggcttaaaacaacaacatttattttgttcaggaatctgtagtttcagcagggctctsaggaacagcttgtctctgctccagcatcagctgaagcagcttgaaagccagggtctgagatcatctgaaggttgttcactcatgagtctgaggaatgatg

SEQ ID NO: 33579 - DNA, 201 bp, Homo sapiens
gctctcaggaacagcttgtctctgctccagcatcagctgaagcagcttgaaagccagggtctgagatcatctgaaggttgttcactcatgagtctgaggawtgatgctgactggtgggtgggacccttgctggagggtctattggctggaacacctacacattgtctccatgtaccctgagcttcctcacaatatggcggc

SEQ ID NO: 33580 - DNA, 201 bp, Homo sapiens
agtcaatttcatctaggagcattttatggcttatggaaagaaatattctcttagattgaagggcgccagcctgtaatgggcatcagctgattctcagaaaraagaaacaacgtactgttacataattggggcttctccaaagtggcctgaccaaactgtagagctgcttgtttgtctgatacggtagccattagccacatg

SEQ ID NO: 33581 - DNA, 201 bp, Homo sapiens
tccattttaaagcgttattgaatccatactaacctgatcattacatatttactaattgatgattactaaaaatgtggacctttgtgaatttccgatgtcayagaagggtgttcttaactggaaaagtcagtagccaacattctgggaagtagaggcctcttcctcactgcttcattggtttaaaataaactccaacagaaa

SEQ ID NO: 33582 - DNA, 201 bp, Homo sapiens
cgtggtgtgtgatcttgaccactagcctaaactgctattttatgtccacccatcaacctctacggctgcccctcatttgaacacacaaaatatagttgtgyggcttggtggagccatctaaattccgttaggccatttgccaatgctgctattaggggcgaaatgtcatgcgcttgatctaaatgtacttaggagaattct

SEQ ID NO: 33583 - DNA, 201 bp, Homo sapiens
cacctggatctgttaaatggcagcttagctatgaaatatcatgttctgcccaatcacctaccctgcctcatatgatcagccggtatatttatgtggacacrtgcagccacacttgtttttaacatttgagaatgacagcgtattggcagttcatataagctatcaaatattacatgtcaactcagaaaacatccctaggaa

SEQ ID NO: 33584 - DNA, 201 bp, Homo sapiens
ctgttgtacactgtcccttcaataaaagttgctaacaccaccaccttgcccttgaattctttcctgggcaaagccaagaaccctgttggcctaagccgcarttctggggttcgcctgccctgcatcaccagcacagtggaaggccacaagctcacagcattttcatccgtaaacaaagcttggcaatatctctgatggtta

SEQ ID NO: 33585 - DNA, 201 bp, Homo sapiens
ggctaataaagtagatgagtttcaggattgcaaaatattgtgatcctggcctttgtccattgtgtaatcttcacagtgaccagagtgtttgcagttcctasgaagttcacccattcccaacagtgtcccagggtcaagctcagatgacctgtggtatttttatacccatatatgtgtcaatgtttataacttttaaagttg

SEQ ID NO: 33586 - DNA, 201 bp, Homo sapiens
agggtcaagctcagatgacctgtggtatttttatacccatatatgtgtcaatgtttataacttttaaagttgttttcaggaagcactgaggcatgtggtcrttcacaggtgacaaagacagaggctcagggaactcagttggttgctgagctttaaacccaagtctatttctgaggctggactgagtctttgagaaaatgc

SEQ ID NO: 33587 - DNA, 201 bp, Homo sapiens
gtttgctggctcatgcgtttcatgccttctctatggtaccatacaggcactttgtctcccagtggaatataagttctttgaggccaaggactgtgtcttaytctgtgttgcatccctttggcttcagcctcattgtcttgcgtttattaagcatttggaacatttcagctgaatgagtgaatgagtgaatgagtgaagcca

SEQ ID NO: 33588 - DNA, 201 bp, Homo sapiens
tttgaggccaaggactgtgtcttattctgtgttgcatccctttggcttcagcctcattgtcttgcgtttattaagcatttggaacatttcagctgaatgastgaatgagtgaatgagtgaagccatcagtcaaatcagaacactgctcacacatgcatcccaagtccagctgtcgaacgtctggaactgagcagtatggag

SEQ ID NO: 33589 - DNA, 201 bp, Homo sapiens
accatgtccccattgaacactgctctgtgctgagtctgcagaatatttaaataaggggttaatttataaagtgagctacgggaaagtttccaggattgtcrtgcgtgtgtctcataaatcggcacaaattgaatctaggtttctaggtttctgtgcccctcagctcctaagtaaaccaaaatttattgagaggtgtatagg

SEQ ID NO: 33590 - DNA, 201 bp, Homo sapiens
acttgcctaagaacacacagcagttctgaaactcaccctgtgctaatctgacctcgtgaagaaattgagcaaactaggctccagggagaaacgaaaacaayaacaacaaaaaatgtattgccaaaaaattgctagcagacatctagaaaaatgtcttcaacttcttttggtaggaaaagaggaaaaattcaaatctgaatt

SEQ ID NO: 33591 - DNA, 201 bp, Homo sapiens
ccgaacatcaatcagggaagataaacaatgggaaatgataggtgtacaaaagggaaaatggcaacagcacatgtggagggaaagaccgcagaattctggcrgggttataaatcatacagtcaaataatttccgtgcaattaatatcctcaaattaaaacatacgtttttaaagaaagattttgcagacttttaagctgggc

SEQ ID NO: 33592 - DNA, 201 bp, Homo sapiens
ttttattttagataaaatgaaaagatgttactatgcaggtaactttatttattatttgcatgcagtttatcaaatagaattccttggttcagcaaaatgamacctttaagtcttttagcaccaaatgtttgaaattatcatgaaacacattctaatttggcagtgagttcaggagatgaagactgtcctttagttaacatc

SEQ ID NO: 33593 - DNA, 201 bp, Homo sapiens
tgttattttccttttgtatctagcctaacattgactatcttgtcatttcattttcctataaaatgcctccaccaaggctgaatctttgaattgatcactasaggccttttccctagtagtaacattataataaaactttgactcatgctcataactcgattttccaaaaagttttcctttacaggagaaaagaacagctgc

SEQ ID NO: 33594 - DNA, 201 bp, Homo sapiens; identical to SEQ ID NO: 4174

SEQ ID NO: 33595 - DNA, 201 bp, Homo sapiens; identical to SEQ ID NO: 4175

SEQ ID NO: 33596 - DNA, 201 bp, Homo sapiens
acccttctaaccagtgtttgaagtacgtaagacgttcatttccacttctaatgaggaattagaggaacggaattataaaggaattctggttataattgcakgtacttttagagacgatgtctaacagtgcaacccatagaaccaggctgcctggattcaaatcccagctctgctattactgagatctctatgagagctcag

SEQ ID NO: 33597 - DNA, 201 bp, Homo sapiens
ttcagtgttggatgttcaccgcttctttagggttctaccactcccagtaaatcaagtaataggtttctgttaaaaaccccagtgtgctgatctcagtggcrgccatcttgctttgtaagccttctctagctttatgatgctcccagtatataagacatttccagtgtctagtccaaattagtatttctctaattctcgagt

SEQ ID NO: 33598 - DNA, 201 bp, Homo sapiens
ctcccagtatataagacatttccagtgtctagtccaaattagtatttctctaattctcgagtgtctgatctgcctggctagaatgattaaaacaaaaaaayagcaaatcagtttgacagtccacttcattaagtggaggacagtgttttgattgctatttaatctgtttttccttctgtctgttcttggctatatggaatt

SEQ ID NO: 33599 - DNA, 201 bp, Homo sapiens
taagtgatggctgcttatggccatgccctttcttctgcactttgggtgttttgtctggaattttctctcctttccttttgtgaaaaaggatgaattttccragactctgttatgacagaaactcaccagttctctgttgttaatcaacaaatagattgtgaatgcttgactcttctttttttttttttttaaaggagtttc

SEQ ID NO: 33600 - DNA, 201 bp, Homo sapiens
caagggtaagatctgctgtcttgtgaatgtcaaagaagtttctcattcgcccctttcttctctctcccagtgtctttaatttgttaatgctttcgacttaytttgctttggataattttcaaagtactgctttctctagagatctctaaaaggcagaagttctggctattaaagatttgccattctcagaacagcccagtt

SEQ ID NO: 33601 - DNA, 201 bp, Homo sapiens
acccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcc

SEQ ID NO: 33602 - DNA, 201 bp, Homo sapiens
gacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgt

SEQ ID NO: 33603 - DNA, 201 bp, Homo sapiens
atcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatt

SEQ ID NO: 33604 - DNA, 201 bp, Homo sapiens; identical to SEQ ID NO: 4858

SEQ ID NO: 33605 - DNA, 201 bp, Homo sapiens; identical to SEQ ID NO: 4873

SEQ ID NO: 33606 - DNA, 201 bp, Homo sapiens; identical to SEQ ID NO: 4890

SEQ ID NO: 33607 - DNA, 201 bp, Homo sapiens; identical to SEQ ID NO: 4891

SEQ ID NO: 33608 - DNA, 201 bp, Homo sapiens
agccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtc

SEQ ID NO: 33609 - DNA, 201 bp, Homo sapiens
agaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgtta

SEQ ID NO: 33610 - DNA, 201 bp, Homo sapiens
agggatggttctgtggtgtcccacactcaaataaacatcctttaaatacctctagatgcttataattcctgttgcagccttagtcagtgggagccactgasctgcattcgtgtaggaactgagcaaggttcatctagtctcggtagctagctaccccgagagctggctgattttttttttcttaaatttaattcaagactt

SEQ ID NO: 33611 - DNA, 201 bp, Homo sapiens
ctctagatgcttataattcctgttgcagccttagtcagtgggagccactgacctgcattcgtgtaggaactgagcaaggttcatctagtctcggtagctasctaccccgagagctggctgattttttttttcttaaatttaattcaagacttcatgaagtcaacaaaatggtctgttggaaattattcctaacccccaacc

SEQ ID NO: 33612 - DNA, 201 bp, Homo sapiens
ttagtcagtgggagccactgacctgcattcgtgtaggaactgagcaaggttcatctagtctcggtagctagctaccccgagagctggctgatttttttttycttaaatttaattcaagacttcatgaagtcaacaaaatggtctgttggaaattattcctaacccccaaccactgtcactgccacaatcaaacatattttc

SEQ ID NO: 33613 - DNA, 201 bp, Homo sapiens
taataaatatctgctagtttttaaagtttgagaaaaacccgtattgtggaatgaaaatgatactgacaaggaatacatctagatcagaaatactgatatcstaagtgagatcttgttttttaaaacaaaaaaaagtttaagaaattgtcatataggctgggcgtggtggctcacacacataatcttagcactttgggaagt

SEQ ID NO: 33614 - DNA, 201 bp, Homo sapiens
gatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttttgtt

SEQ ID NO: 33615 - DNA, 201 bp, Homo sapiens
agtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgac

SEQ ID NO: 33616 - DNA, 201 bp, Homo sapiens
tcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggct

SEQ ID NO: 33617 - DNA, 201 bp, Homo sapiens
tgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattatag

SEQ ID NO: 33618 - DNA, 201 bp, Homo sapiens
ctgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccc

SEQ ID NO: 33619 - DNA, 201 bp, Homo sapiens
aggtgaccagaatctgacctggggcaatgccataaatccaagaaagactgggtttcaggtgcaggaaatgcgattgtgcacggacccttgcctttttaccmagtatctagcccatccttctttcttagaagcagaattttctaagaggtacacggtagttcaggataaaaattccctgtgctaactgcccttgcagctagc

SEQ ID NO: 33620 - DNA, 201 bp, Homo sapiens
tggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggat

SEQ ID NO: 33621 - DNA, 201 bp, Homo sapiens
ttttttttttttttttttgagactcactctgtcacccaggctggagtgcagtggcatgatcatggctcactgcagcctcccgggctcaagctttccacccmcctcagcctcctgagttgctgggaccacaagtatgcaccaacatgcctggttaatttttgtggttttttttttttttttttttttcctgctgagatgggg

SEQ ID NO: 33622 - DNA, 201 bp, Homo sapiens
taaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccata

SEQ ID NO: 33623 - DNA, 201 bp, Homo sapiens
tctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtg

SEQ ID NO: 33624 - DNA, 201 bp, Homo sapiens
gggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccggga

SEQ ID NO: 33625 - DNA, 201 bp, Homo sapiens
gaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgccccggccttctttttgtgctgttgggttccaaactttacctgaggattt

SEQ ID NO: 33626 - DNA, 201 bp, Homo sapiens
atcccttatattccttagggttcctttttttcaagttaaagcattgagtcatgtctctgataaatcgcccccccaccccgatccccaccctctgccgcccyggccttctttttgtgctgttgggttccaaactttacctgaggattttcacatgcacatctgttaaatgccatttaaagagaacactaacaagagaaagct

SEQ ID NO: 33627 - DNA, 201 bp, Homo sapiens
cctacttttaaaaaattgaggtgaaattcacataatataagattaaccatttcaaagtagacagttcaatagcagtacattcacaatggtgtgtaaatacygcatctatctatttccaaaatatttgtatctccccacaataaaagtctgtaccaattaagcagctactacccattcctcttccctaccattctaccttct

SEQ ID NO: 33628 - DNA, 201 bp, Homo sapiens
aaaatatttgtatctccccacaataaaagtctgtaccaattaagcagctactacccattcctcttccctaccattctaccttctgtctcagtaggtttgcytatttgggatattttatttaagtgggatcatacaatagcatcatgtgttcaaggttgacccacattgtggcatgtatcagtacttcattcccttttatca

SEQ ID NO: 33629 - DNA, 201 bp, Homo sapiens
gaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgca

SEQ ID NO: 33630 - DNA, 201 bp, Homo sapiens
gaagctgaggcaggagaatcacttgaactcagaaggccaaggttgtagtaagctgagattgcaccactgcactgcagccttggcaacagagcgagactccmtctcaaatcaatcaaccagtcaatgtgtgcccccttttcctccaactcccaccccaaatccttgctgaatcatacctatccttcacctttataagcatct

SEQ ID NO: 33631 - DNA, 201 bp, Homo sapiens
ctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagct

SEQ ID NO: 33632 - DNA, 201 bp, Homo sapiens
tgtggcacatacccctgtacatgtttgccaagactgctatatggtagagcttggaattcttaggagctttatcaggtaattgcaagtcccccacctccaasaaagcactctctaggtcaagaatcagcaaatgttttctatagaggcccgtaaaattaatattttatactttgtgggtcatatagtctctgtttcaattac

SEQ ID NO: 33633 - DNA, 201 bp, Homo sapiens
aagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaagg

SEQ ID NO: 33634 - DNA, 201 bp, Homo sapiens
ttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggc

SEQ ID NO: 33635 - DNA, 201 bp, Homo sapiens
tttagtaaaacgcagtatcttcttccccagctgaaatagcgaaagggtctcttcaggctcctgggataaaaaccaggatccttcatgtgtctgagcaggcytcccaccatttgactgctgctcctttgtccagacacatttaacaccatctccctgcaccccttcactgggctccgaagctgcgttcacacggcacgtcat

SEQ ID NO: 33636 - DNA, 201 bp, Homo sapiens
cacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagatggggaattaaggttgcagatggagttaaggtt

SEQ ID NO: 33637 - DNA, 201 bp, Homo sapiens
ttagatcccatctctggtagacagagtaatgagccccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccagtcgaatcagag

SEQ ID NO: 33638 - DNA, 201 bp, Homo sapiens
gttacatggcagatggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagaggga

SEQ ID NO: 33639 - DNA, 201 bp, Homo sapiens
cacatatcccacatccaggtgccagtcagggagctgcgatttaatttgctgctgaatgcacttttgaataaagggcctagaagatgcagtctcgaggaacsgaggccggttagagacaggctggcagctttgcctcctctcccaagacaaaggcctccccgcccccctaaatccagcacacaatcagctgctctccctccc

SEQ ID NO: 33640 - DNA, 201 bp, Homo sapiens
tgccccttatacattaaggtgcatgcaataaatcacttatgtaataaactactctatattatgtgggaaaaaaaaaaggagctggtggcagggggagagayttcaaattgagccagacctcaggcatgaagggaggggagagagggggaaatgtggaggaagggggcgtttgtgcagtgggaagttggagaaagtacaaat

SEQ ID NO: 33641 - DNA, 201 bp, Homo sapiens
ttaaggtgcatgcaataaatcacttatgtaataaactactctatattatgtgggaaaaaaaaaaggagctggtggcagggggagagacttcaaattgagcyagacctcaggcatgaagggaggggagagagggggaaatgtggaggaagggggcgtttgtgcagtgggaagttggagaaagtacaaatgaaagcctctctg

SEQ ID NO: 33642 - DNA, 201 bp, Homo sapiens
aaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactct

SEQ ID NO: 33643 - DNA, 201 bp, Homo sapiens
cctggggcctttgctctttgcccttccctttgccaagaaagttccctgtactctgcaatgctgagtacttctcatccttcaggtctactgcaagtgtcacytggccaacacaccatgccttcccagtctctggtgttactctctgcatactgtagaccatcatcttgtttgcatacttgtctgttatctctttatcatcct

SEQ ID NO: 33644 - DNA, 201 bp, Homo sapiens
ctggccaacacaccatgccttcccagtctctggtgttactctctgcatactgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaata

SEQ ID NO: 33645 - DNA, 201 bp, Homo sapiens
tattcacagttgccgcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgctcccgacaccaggtcatact

SEQ ID NO: 33646 - DNA, 201 bp, Homo sapiens
ccatagtctgtgaaatccccatttcacagatgttgaaactgagacttagaagcattatgcaccatgccaaaggccatggaaggacagagcttgggcatgcycccgacaccaggtcatactgatgtcactctccctactcccttcactccctccagcacctggccttcacctgaaggtgctgaccttgctgtttgttggttt

SEQ ID NO: 33647 - DNA, 201 bp, Homo sapiens
caaattttcaaaggaagaaatggaatggtgcaaccatggtacatgggaaggaggagggggacacacaagactgtacctatcatgggggcttcgacctcatstgggaaggtggttggagagagtgagtcctgacctgagctttggaacttatcaagttgagagagaaatttgataatttgtctattaacgtgtgaccttggg

SEQ ID NO: 33648 - DNA, 201 bp, Homo sapiens
caagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccaccc

SEQ ID NO: 33649 - DNA, 201 bp, Homo sapiens
gttttgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagat

SEQ ID NO: 33650 - DNA, 201 bp, Homo sapiens
aaaggcattaatctttttggtatccaacatcttgaatgcttctgtgtcattttcctttctttttttttttcaaagcacttaattatttaaaaacaaaaatmcttctctgatcagagcatacctgccgtgctcaaagcacttgcttacttggaatgccataaattacatgaaggaattattcattgtatcacgaaacatacc

SEQ ID NO: 33651 - DNA, 201 bp, Homo sapiens
atgagcagttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtggttattcccagaaagatccagtgaattgtctcctgaagataaaatacata

SEQ ID NO: 33652 - DNA, 201 bp, Homo sapiens
tgaaccccaggacagggtgagaggccacctgcacactttttttttgtcagctcacaccctgttggccctttgcaaatatttgtctttcctcatgcacgtgkttattcccagaaagatccagtgaattgtctcctgaagataaaatacataaaagggcgtttcaaagtataaacagtgattttaatgaaaaataagaagaaa

SEQ ID NO: 33653 - DNA, 201 bp, Homo sapiens
ttttttgtcagctcacaccctgttggccctttgcaaatatttgtctttcctcatgcacgtggttattcccagaaagatccagtgaattgtctcctgaagawaaaatacataaaagggcgtttcaaagtataaacagtgattttaatgaaaaataagaagaaaatgcttatgatacaacattaggtggaaaacgaaggaaga

SEQ ID NO: 33654 - DNA, 201 bp, Homo sapiens
aacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcat

SEQ ID NO: 33655 - DNA, 201 bp, Homo sapiens
aggcccaagcgatcctcctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatcagccactggg

SEQ ID NO: 33656 - DNA, 201 bp, Homo sapiens
tagagacaaggcttcactatgttgcccaggctggtctcgaactcctgagctcaggtgatctacctaccttggccccacaaagtgctgggcttacaggtatsagccactgggcctggcctgagttgataatttttgtcatttctttctcacttttctcaggaaaatcatgactgtaaaacagatcagttttgctttagttcc

SEQ ID NO: 33657 - DNA, 201 bp, Homo sapiens
tctcgaactcctgagctcaggtgatctacctaccttggccccacaaagtgctgggcttacaggtatcagccactgggcctggcctgagttgataatttttrtcatttctttctcacttttctcaggaaaatcatgactgtaaaacagatcagttttgctttagttcccaccctcatcatcaacccctccccagctaccctg

SEQ ID NO: 33658 - DNA, 201 bp, Homo sapiens
ctcctgagctcaggtgatctacctaccttggccccacaaagtgctgggcttacaggtatcagccactgggcctggcctgagttgataatttttgtcatttmtttctcacttttctcaggaaaatcatgactgtaaaacagatcagttttgctttagttcccaccctcatcatcaacccctccccagctaccctgcaaaaga

SEQ ID NO: 33659 - DNA, 201 bp, Homo sapiens
agctcaggtgatctacctaccttggccccacaaagtgctgggcttacaggtatcagccactgggcctggcctgagttgataatttttgtcatttctttctyacttttctcaggaaaatcatgactgtaaaacagatcagttttgctttagttcccaccctcatcatcaacccctccccagctaccctgcaaaagagtcaca

SEQ ID NO: 33660 - DNA, 201 bp, Homo sapiens
gaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcc

SEQ ID NO: 33661 - DNA, 201 bp, Homo sapiens
acttgtttcctgtgagggtgccaggaaactttacaatgaacttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggat

SEQ ID NO: 33662 - DNA, 201 bp, Homo sapiens
ggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacatacataataactgctcaataaag

SEQ ID NO: 33663 - DNA, 201 bp, Homo sapiens
aagtatatgtagcaaccaaacagtttcttctttcctaaaactcaaagtgagtcagacttcttaggcttgtagatgttgaggactaagctttgctctttatmttctctttatggatttccctttggaagcagggataagaagagggaaggtctcccagatgtaaatttctcataaatatttgagctccatttcagtaattct

SEQ ID NO: 33664 - DNA, 201 bp, Homo sapiens
aaagtgagtcagacttcttaggcttgtagatgttgaggactaagctttgctctttatcttctctttatggatttccctttggaagcagggataagaagagrgaaggtctcccagatgtaaatttctcataaatatttgagctccatttcagtaattctttcattctctgatctgttgcctaatcttctatttagcaagtac

SEQ ID NO: 33665 - DNA, 201 bp, Homo sapiens
ctcatctctttagattagtgattctatattggtgagggagtggaagagaaatgtgggtgtgttgactatattctccacagaaactttttgaagtagcatcstcactcagcacagaacattttgacaatacacttccagggcaggtggtttcttactatgtccctccctacccccacatactttgggactcagaatgtaggg

SEQ ID NO: 33666 - DNA, 201 bp, Homo sapiens
tgacaatacacttccagggcaggtggtttcttactatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctg

SEQ ID NO: 33667 - DNA, 201 bp, Homo sapiens
gccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttg

SEQ ID NO: 33668 - DNA, 201 bp, Homo sapiens
ttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcg

SEQ ID NO: 33669 - DNA, 201 bp, Homo sapiens
tacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcagg

SEQ ID NO: 33670 - DNA, 201 bp, Homo sapiens
gatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaaga

SEQ ID NO: 33671 - DNA, 201 bp, Homo sapiens
gaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacactt

SEQ ID NO: 33672 - DNA, 201 bp, Homo sapiens
aacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatgtctgagacttg

SEQ ID NO: 33673 - DNA, 201 bp, Homo sapiens
ttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtcct

SEQ ID NO: 33674 - DNA, 201 bp, Homo sapiens
tttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcat

SEQ ID NO: 33675 - DNA, 201 bp, Homo sapiens
tttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaagcctt

SEQ ID NO: 33676 - DNA, 201 bp, Homo sapiens
tttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaac

SEQ ID NO: 33677 - DNA, 201 bp, Homo sapiens
tctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagt

SEQ ID NO: 33678 - DNA, 201 bp, Homo sapiens
tgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaa

SEQ ID NO: 33679 - DNA, 201 bp, Homo sapiens
aagaaatggagcaagggaggggtttcatcccgccgtgttcatttgcttggctgtcctgaaattgcgaatacgcagttgttacctgctcccggtgggagggrggggatatttatttggcatcttgcaattgataggagctgagtgattttagtaggtagtttaactccttaaaaacttccagtggtttcatattctacctag

SEQ ID NO: 33680 - DNA, 201 bp, Homo sapiens
tgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgctcctgccagctctaatagggaatgtgtg

SEQ ID NO: 33681 - DNA, 201 bp, Homo sapiens
ggaacatgtgctctgtgtgctggaagctcctggaggccccagggttatctctgctcacttaggtttgtgatgttgggcaaaaggagaaaatgctgagtctrttcggacccaacttccattaatgcctgagaaataatttaaatcgcaagatttccaatcccataagcagccctagcctctcttctcctgatactccacata

SEQ ID NO: 33682 - DNA, 201 bp, Homo sapiens
caggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcg

SEQ ID NO: 33683 - DNA, 201 bp, Homo sapiens
ttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaaga

SEQ ID NO: 33684 - DNA, 201 bp, Homo sapiens; identical to SEQ ID NO: 27137

SEQ ID NO: 33685 - DNA, 201 bp, Homo sapiens; identical to SEQ ID NO: 4904

SEQ ID NO: 33686 - DNA, 201 bp, Homo sapiens; identical to SEQ ID NO: 4910

SEQ ID NO: 33687 - DNA, 201 bp, Homo sapiens
tgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagat

SEQ ID NO: 33688 - DNA, 201 bp, Homo sapiens; identical to SEQ ID NO: 4975

SEQ ID NO: 33689 - DNA, 201 bp, Homo sapiens; identical to SEQ ID NO: 4977

SEQ ID NO: 33690 - DNA, 201 bp, Homo sapiens
ccgcacccggccctgtttttgcatttttagtagagacgggttttcaccaggttggccagcctggtctcaaactgttgaccttaggtgatctgcctacctcsgcctcccaaagtgctgggataacaggcgtgagccactgcgcctgtctacattttctgtctttactggtattatggtgggaacccataaaccactgcgagg

SEQ ID NO: 33691 - DNA, 201 bp, Homo sapiens
tgcgcctgtctacattttctgtctttactggtattatggtgggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaag

SEQ ID NO: 33692 - DNA, 201 bp, Homo sapiens
acaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagcta

SEQ ID NO: 33693 - DNA, 201 bp, Homo sapiens
ctgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggc

SEQ ID NO: 33694 - DNA, 201 bp, Homo sapiens
gtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgctt

SEQ ID NO: 33695 - DNA, 201 bp, Homo sapiens; identical to SEQ ID NO: 14931

SEQ ID NO: 33696 - DNA, 201 bp, Homo sapiens; identical to SEQ ID NO: 14932

SEQ ID NO: 33697 - DNA, 201 bp, Homo sapiens
ggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgct

SEQ ID NO: 33698 - DNA, 201 bp, Homo sapiens
cacaaatgtgatccttctggaggccagaagatagattcagtgggccccagttctttcaggtttaaggaataagcattttggtctatgaaaaatggggtttkcctaaagtataagattgtcttatatttataaatgcctgtgttcattgctgtgggttcactgctttctcttttgggcagccatataaataaaagaaccacc

SEQ ID NO: 33699 - DNA, 201 bp, Homo sapiens
ctgggacaaggacgatggacaaagttatgggggtgctaaaaacctcagtaatgaagataaatgatattctaatctaatattttaaaaaatcgaggctaggygtggtggctcatgcctgtgattccagcattttgggaggccaaggtggacggatcaccagagttcaggagtttgagaccagcctggccaaaatggtgaaat

SEQ ID NO: 33700 - DNA, 201 bp, Homo sapiens
agttatgggggtgctaaaaacctcagtaatgaagataaatgatattctaatctaatattttaaaaaatcgaggctaggtgtggtggctcatgcctgtgatyccagcattttgggaggccaaggtggacggatcaccagagttcaggagtttgagaccagcctggccaaaatggtgaaatgccatctctactaaaaacacaa

SEQ ID NO: 33701 - DNA, 201 bp, Homo sapiens
tctaatattttaaaaaatcgaggctaggtgtggtggctcatgcctgtgattccagcattttgggaggccaaggtggacggatcaccagagttcaggagttygagaccagcctggccaaaatggtgaaatgccatctctactaaaaacacaaaaattagctgggtgtgtggtagtgtgtgcctgtagtcccagctactctgg

SEQ ID NO: 33702 - DNA, 201 bp, Homo sapiens
ctgcctcctaggctcatgccattctcctccctcagcctcctgagtagctgggactgcaggcgccagccaccacgcccggctaattttttatatttttagtmgagacggggtttcaccatgctaaccaggatggtctcgatctcctgacctcgtgatccaccagccttggcctcccaaagtgctgggattacaggcattagc

SEQ ID NO: 33703 - DNA, 201 bp, Homo sapiens
cagagcatttatctttgatgctgggaatgcgttcattttctttatcttgccattactgtacctctattgggaaatttactctctcttcatagataggatcmgattcagtacatatttataaaaccacacttacatttaaatacaggcctttcccatttcacagtgtttctagctcccctttccaatacatctctctctctc

SEQ ID NO: 33704 - DNA, 201 bp, Homo sapiens
gatgctgggaatgcgttcattttctttatcttgccattactgtacctctattgggaaatttactctctcttcatagataggatccgattcagtacatattyataaaaccacacttacatttaaatacaggcctttcccatttcacagtgtttctagctcccctttccaatacatctctctctctctttctctctctctctc

SEQ ID NO: 33705 - DNA, 201 bp, Homo sapiens
cagcctgggcaacacagcgtgactccatctcaaaacaaacaaacaaaacaaaacaaaaaaggtttaagaaatgttctagtaccttgaaaccaaaataggtrtcagatacttggctgttttgttttttcttcttagccattttgacctgtgagattttatgtgatgaaaacataagaatgtggtattacaccctgtgatttg

SEQ ID NO: 33706 - DNA, 201 bp, Homo sapiens
ggtatcagatacttggctgttttgttttttcttcttagccattttgacctgtgagattttatgtgatgaaaacataagaatgtggtattacaccctgtgakttgaattttccatactccattccattctatatgtcagatgcatcttcctaaaacacacctttgtcacatcactcctctgctcaaaaacattcagtggctc

SEQ ID NO: 33707 - DNA, 201 bp, Homo sapiens
ttggcttctccacagaggcctggttctggtcccttcccctgcaaccccaaggcagggggcagattcccgtatcatggtgctccttggcctgattctgtggsctttatattagaactcaccttctggaatcttttattgtcttgttctctcttccaagctgcgcatcttccttcccttcagaggtttggtgatcagcgtggt

SEQ ID NO: 33708 - DNA, 201 bp, Homo sapiens
atgtctgatagatattaggcattcagtctctctctctctctctctctctctgtttattatagatagaaataaaaaaattataaatagaaatttatttctcrtggttctagaggctggaaaattcaagatcaagatgcagacaggcttggtgtctggtgagggctgctttctatccttcaaaaaggcaccacgttgctgtgt

SEQ ID NO: 33709 - DNA, 201 bp, Homo sapiens
tgtggaaaagggacatggcccagggaaccagagtggtttgggaaagcactttgtcaagaggcttggggaccccagggtggaagctgccatgcgcatgaggytgtgttagcagaggcagtggcagaagaagacattgcaaacctgcaaaagcaacctctgaggatgggtagacatatacttcattgcaggcagctgctgctg

SEQ ID NO: 33710 - DNA, 201 bp, Homo sapiens
tggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagtt

SEQ ID NO: 33711 - DNA, 201 bp, Homo sapiens
tccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttc

SEQ ID NO: 33712 - DNA, 201 bp, Homo sapiens
atatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactg

SEQ ID NO: 33713 - DNA, 201 bp, Homo sapiens
attgtgagccacacatgcaagggatctaggctgcatgctccttacgaaaatctaatgcctgatgatctgtcactgcctcccatcaccttcaagatgggatygtctagttctaggaaaacaagctcagggctcccaccgattgtacattatggtgagttggataactatttcattatatattacaacgtaataataatagaa

SEQ ID NO: 33714 - DNA, 201 bp, Homo sapiens
cacacatgcaagggatctaggctgcatgctccttacgaaaatctaatgcctgatgatctgtcactgcctcccatcaccttcaagatgggattgtctagttstaggaaaacaagctcagggctcccaccgattgtacattatggtgagttggataactatttcattatatattacaacgtaataataatagaaataaagtgc

SEQ ID NO: 33715 - DNA, 201 bp, Homo sapiens
cctcagtgatcttctataacataagttgatagtcaataattgcttaatgggaatcataaatatgagtttatttatatgtgtatatatatatatatatatawaatatatttccatgaatatactgaatgctaagccctccccactttttttttcttttttaaattcagaaatttctagttgtgtttattcccctcgtcagca

SEQ ID NO: 33716 - DNA, 201 bp, Homo sapiens
tgcctgcttcaataccaagaagctggtcttatttagatctagtcttatatcattgaaatatcattagaattcttatggaaaatatgttttggctgtttagrggatgctaggggctggaagtgagaaggtttcaacaccatatgggtatgtgagtatagatgcttacaagaagaagggtagacttagccaaaactaatttgg

SEQ ID NO: 33717 - DNA, 201 bp, Homo sapiens
aaacccctaaattgtggtgcctcagtgatcttctataacataagttgatagtcaataattgcttaatgggaatcataaatatgagtttatttatatgtgtrtatatatatatatatataaaatatatttccatgaatatactgaatgctaagccctccccactttttttttcttttttaaattcagaaatttctagttgtg

SEQ ID NO: 33718 - DNA, 201 bp, Homo sapiens
aggttgctgtgaggcaagatcacaccactgccttctagcctgggcagcagagtgcgaccttgtctcaaaaaaaaaaaaaaaaaaaaaaaaaaaagaaaaaraaaagttggaatgacatcagactcaaaatgtgtcacttagcagtggggatgcaattctgagaaatgcatggttaggtggtttcatcattgtggaacatca

SEQ ID NO: 33719 - DNA, 201 bp, Homo sapiens; identical to SEQ ID NO: 23321

SEQ ID NO: 33720 - DNA, 201 bp, Homo sapiens; identical to SEQ ID NO: 4872

SEQ ID NO: 33721 - DNA, 201 bp, Homo sapiens; identical to SEQ ID NO: 4857

SEQ ID NO: 33722 - DNA, 201 bp, Homo sapiens; identical to SEQ ID NO: 23322

SEQ ID NO: 33723 - DNA, 201 bp, Homo sapiens
cgattattgtatttaacttctgttggcatcattcgcatacttgtatgggagatccagaattggaatttaacacagttttcccaggcccttcatggaatttraaaacatgactctgaaagcatgtggctgaaatgagactctttcacactgtttaaagatgcatgtgcatatgttggtgtccacacatcaacttaatttttt

SEQ ID NO: 33724 - DNA, 201 bp, Homo sapiens
agggaacagggagacagggagcctttcttcctttcctcacccccagttctgtgtttatacttctcatttagcccataccccactatattaaaagaagatgyataagtgtatgtgtttaatctaccattccttgtggcacagtgcatggtctgcatggcacagtgtgtggtctgtatggcacagtgcatggtccgcatggca

SEQ ID NO: 33725 - DNA, 201 bp, Homo sapiens
aagctatgaaacatgccaatttataaattgctatcactactttagttccgctcatttaaaatgaaatagctgaatgccgagtgagtgaattgggcatcttyacttccaagacttctggggcattcaggagtcatattctatctaagctttaatggtgttggtgttccctttcctttggccactcaagggagcctgttttct

SEQ ID NO: 33726 - DNA, 201 bp, Homo sapiens
tttacttccaagacttctggggcattcaggagtcatattctatctaagctttaatggtgttggtgttccctttcctttggccactcaagggagcctgtttyctttggataaaccgtgaaatctttaaccctgtgaatgtccgttttctctaaggcggggtgggctgaaacataacataacaggatttattttgaaagtggt

SEQ ID NO: 33727 - DNA, 201 bp, Homo sapiens
gtcttgggcggcgggtgcctgcaggatagatcaaagggtaattgagtctgtgcctggggccccttccactgtacatgccaccatcctgttgggaggaatarcagcacactcctgaatgagctctttctaagcagctcattcattttgttaatcctgagtttggaatcaaccaatttatttaaacccgtgaagcctcgctct

SEQ ID NO: 33728 - DNA, 201 bp, Homo sapiens
gaaagaaattggcctaactcctcagtttgcttcactaaaatcttttaagcacacatcttgtctattatgccagctgcaactcaaatcaaaggcactgttgmtttggtacccgcatttaaggagggaataccccaaaaaacttaaacttgtctggctttgcaatggtggtggagtcccaagatgacacagtaggcaagattt

SEQ ID NO: 33729 - DNA, 201 bp, Homo sapiens; identical to SEQ ID NO: 14933

SEQ ID NO: 33730 - DNA, 201 bp, Homo sapiens; identical to SEQ ID NO: 14934

SEQ ID NO: 33731 - DNA, 201 bp, Homo sapiens; identical to SEQ ID NO: 14935

SEQ ID NO: 33732 - DNA, 201 bp, Homo sapiens; identical to SEQ ID NO: 14936

SEQ ID NO: 33733 - DNA, 201 bp, Homo sapiens
ggctggtggaataagatgttttcctgttttcaagatgcagtggactctcttttatttaacagcagtgtctatgtgttaggaatccatgtgagttctctaartctgggacaacgataggtgtgtctgagtcctgcattaccatggtttattctttcctttacccagtatctattggagttgggcttctgttgctttatttct

SEQ ID NO: 33734 - DNA, 201 bp, Homo sapiens
tcagcatctgctggacattgagatggccacaggttggtcagagagggctggtatgggaagaggggcaggtggctctcccttagagttactatttgactcasccctgacttcccagaatgtgtcttgagtctattaccctctcatatgggaggggtgacccaagtatgtttgtggcaaccaaaatgtctccaggcattgcca

SEQ ID NO: 33735 - DNA, 201 bp, Homo sapiens
ctgtttttcatatttattgtgggacatttagagaatctcagactagcaggtgttagattaaacagaggagaaacggtccttgtggtgataaaacttccctrcgcaaggacaagtagagaaacaactgtagatgaagcagccagtctcaggctggggcagcacgccctgcgataggttaaggtttattttagacaaatattt

SEQ ID NO: 33736 - DNA, 201 bp, Homo sapiens
gtttattttagacaaatatttaaaatgcagctaatttttacatatgcagacgcaacccagtggaatagaggtagccccagctttggagtcatacagatctrgggttaaatcccagtgtgaatactaactcactcggtgtccctgggcaaatctggtcatctctctctctcttttctttttttgagatagggtattgctctg

SEQ ID NO: 33737 - DNA, 201 bp, Homo sapiens
taataagaatctgactaaggttattaaccattaaggtatgctgtgctaaggagcagggggccccttccatccgtagagggcagaaaggtgcctatcatgtsttcagtgtcagtgccctggtatggagctagctggccttccacaggttctggagttaatgctggagagaagtaggggtgtcagagcctaccctgtgttcct

SEQ ID NO: 33738 - DNA, 201 bp, Homo sapiens
ctggattcttcctcttatgggtagtgatgggcactttaggagtaggaatacatgtcagtgctagaccacatcctttcatacccggaattcgcatagtgacrtttaaaaatagatagcaggccaggtgcggtggctcacgcctgtaatcccagcactttgggaggccgaggcgggtggatcacttgaggttaggagttcgag

SEQ ID NO: 33739 - DNA, 201 bp, Homo sapiens
atttactgagtgagtgagagggtaaaacagctgagccatgggagttataacttgggcagcagtaatcctgccattgtaggaggggacagatcggctggttrgtttttggaaagcagaccagcagaagttgcaaataacttgttgtgttttcctaagtactgagctgtgtgaattggtttcatgttgatgttactgaagtct

SEQ ID NO: 33740 - DNA, 201 bp, Homo sapiens
cagagctgcagctcacctgtgccacgatggtctcctaggagccctttcctgctgtagtcccgccccgaggggtttcacttcccactgcctcttggtagccrtgggcactttggtgctctgatgatgtaacatggagattgtccttgtctccatcgctgtctttactggtgtatgcccatgaggtatgtcaaagtctgtatg

SEQ ID NO: 33741 - DNA, 201 bp, Homo sapiens
actacctgtagcaagagcatgtctttgagagccatagcagctggcttcctatttggagagaacaagaatgtgaaaagctatttattaccagatgtgggcasaccctccagcctttttttgttcttttaaaccctaatctctttttaaaattttttttatttttaatgtttatgggtacatagtaggtgcttatatttgtgg

SEQ ID NO: 33742 - DNA, 201 bp, Homo sapiens
aaggtcacacaactaaaagaagtgacaaagtacggtttcagacccttttagtcttttctgtgttgcaaaattgagataatgataatagctaatgatacctstcccttactgataattgaatgttttatgtgaattaaaaagtttaatctgcatagtgtttcatcaagatagattccttgttatcctcattttggagatgaa

SEQ ID NO: 33743 - DNA, 201 bp, Homo sapiens
agagctaagtgatttaagtacatctgggataaagtggccttggctttaactatgaaacaaattttctttatttcattctcttcactgataaatccatagtractggaggcatttttagaattgtgggcaatttcagcctctaaagtttgattaaagatacttcagatattcctactgagaggctagagggctgaaaggaat

SEQ ID NO: 33744 - DNA, 201 bp, Homo sapiens; identical to SEQ ID NO: 8816

SEQ ID NO: 33745 - DNA, 201 bp, Homo sapiens; identical to SEQ ID NO: 8817

SEQ ID NO: 33746 - DNA, 201 bp, Homo sapiens; identical to SEQ ID NO: 8818

SEQ ID NO: 33747 - DNA, 201 bp, Homo sapiens
tccccttgtgggctggcagcatttttgctaacactgccttaaatgatgctactggcaggatggttaatttgatgttgaaatgtcacacaatatgtgcccaycctacgatttgaatcttctgtgccgttaagggaattggcagtgttcagacagaatggtaacattctctctgatcgtgtctgtgtctgcacccttttttgt

SEQ ID NO: 33748 - DNA, 201 bp, Homo sapiens
tcattcagttcagatttgctacttgttctcttggttccttcaaagtaatgactaagtacaggtctttagatagagagctgcaccaaccaggtattgcttcrtgtcttccacgtacgtcctgagaaagcgaaggtgaatttcaccaattggtaggtggaaatagaaaaactgttgattctttttttcattcaccaatctttt

SEQ ID NO: 33749 - DNA, 201 bp, Homo sapiens
acttgttctcttggttccttcaaagtaatgactaagtacaggtctttagatagagagctgcaccaaccaggtattgcttcgtgtcttccacgtacgtcctsagaaagcgaaggtgaatttcaccaattggtaggtggaaatagaaaaactgttgattctttttttcattcaccaatcttttttttccccaaatgctaagct

SEQ ID NO: 33750 - DNA, 201 bp, Homo sapiens
gctcttgaaggcaggcttaacaagttcctctgagtattacagttggagtcagttgtggaaaaggtaatttaagcaacttgcagcgaggccattcagaatckcagcgatgatcctaaatatctttctctcttgctcacgctcttttttttttttcttgtttcctctggaagctggtagcaggagctttcaaagtctgtgatt

SEQ ID NO: 33751 - DNA, 201 bp, Homo sapiens
aacgttgtagcatgggcaggaaataattgggttgtatgtaatgcccagtaaagtaaacagatcttagagagggacaccgatccctaccctgcatggggttwttcacagagccatggggacactaaacgtaccttatctcttgaccatgctattgattagttatgtgtttgcctgtgttattaataatgtatacattgaaaa

SEQ ID NO: 33752 - DNA, 201 bp, Homo sapiens
aatttttcaaagaggtaggctggaagtaaatttaaaaattttcccctttctggcagagggcttttttctgatcaccacccatgttaattagatatgcatgkatgtgtatgtatgatgtatatacccatatacacacagtctatatatacatgtatgcgcacatacacatattttaaggaaagaattataaaatgatcaatt

SEQ ID NO: 33753 - DNA, 201 bp, Homo sapiens
gtagaaagagataaagctttgcttaattaatgtctgttttccctctgttcagaagtataaggaaaaaggggactgaaattagtgctgataaaagcttgaawtagacattatagcactgaaacttctttttcttccttacttagaatttggaagaacatacttcatacaaagctatgaagcatattggaagattttaggtgc

SEQ ID NO: 33754 - DNA, 201 bp, Homo sapiens
cagcttccttctcaccttaaccccacgtattgttgcaacggcaaaaaagagaattgcacagaggaacaccacctatcagagttcacactgagtttgcagaktcatccttttgcttccagccatcccatggaatgctgttcttggaagggtcatctcatggtccattgtcggccctcttagaagagatttcaggccttccct

SEQ ID NO: 33755 - DNA, 201 bp, Homo sapiens
gatttgatgcttccagccttagcggttttcttgcttctaggactgaacagggaagagggaaaagtcaaaagaatgacagaaggtcctcacgttgcagaacrctgaccaatgttggcaactacaagacaatcaggcgtgattcttcatccaggatctgcttttccctgtcctgccaattcttgagctgctaataaacattct

SEQ ID NO: 33756 - DNA, 201 bp, Homo sapiens
caccaaaatattccagataacggttatcagtttttgattctacacatacttcaaatactattaatgcaaaatccttctttagaaatgttacctaattccartgtttcactttattcagcgaagacattcctttgattattctggttaggtgttatgatgccaatttgcccacacattttttcttaggcgcctatgcttgca

SEQ ID NO: 33757 - DNA, 201 bp, Homo sapiens
ttaatgcaaaatccttctttagaaatgttacctaattccaatgtttcactttattcagcgaagacattcctttgattattctggttaggtgttatgatgcyaatttgcccacacattttttcttaggcgcctatgcttgcagtagacagagagttgaggaaagctcaaggttaaaacaggaaaaagtaacacagtaaatac

SEQ ID NO: 33758 - DNA, 201 bp, Homo sapiens
ttcactttattcagcgaagacattcctttgattattctggttaggtgttatgatgccaatttgcccacacattttttcttaggcgcctatgcttgcagtasacagagagttgaggaaagctcaaggttaaaacaggaaaaagtaacacagtaaatacctatttttgtgcataattcaaattaaaaccccaaccacctagaa

SEQ ID NO: 33759 - DNA, 201 bp, Homo sapiens
gcgaagacattcctttgattattctggttaggtgttatgatgccaatttgcccacacattttttcttaggcgcctatgcttgcagtagacagagagttgakgaaagctcaaggttaaaacaggaaaaagtaacacagtaaatacctatttttgtgcataattcaaattaaaaccccaaccacctagaagcaccaatacaag

SEQ ID NO: 33760 - DNA, 201 bp, Homo sapiens
acagtaaatacctatttttgtgcataattcaaattaaaaccccaaccacctagaagcaccaatacaaggaactggctgcatattgcattcctgtgacctgytgtcttaatgatggaatgactaacgaggatcagagggaatgtggtcagcctcttatctcataagccaaatgctgcatattccaagcctgtcaattctgaa

SEQ ID NO: 33761 - DNA, 201 bp, Homo sapiens
attcctgtgacctgctgtcttaatgatggaatgactaacgaggatcagagggaatgtggtcagcctcttatctcataagccaaatgctgcatattccaagsctgtcaattctgaaagcccttgttcatttttaaataatgaaaaactttggggccttgttcattgtttctaaaggaagacatttagaaaatttagaatata

SEQ ID NO: 33762 - DNA, 201 bp, Homo sapiens
ctccagcctgggcgacaagagtgaaactccatctcaaaaaaaaaaaaaaaaaaaaaaaaaaattatgtcatttcgttgtcacagcgtcagcagaataaatsttagatcaagatgggattactgcgccactcccttcttcccagtctgtggtttagcacgggaaaaagcaaactagggcccttgggccaaatctgatctgca

SEQ ID NO: 33763 - DNA, 201 bp, Homo sapiens
caacaagagtcacctctaagatgatccagctgttgcatggtgtagcatgcctagtccttgcagcacacacgctgccattcttcttcgccgttgttaccgtrttaatttagggatgatgagaaagtggcctccctttccctgttaattccttggaggaacttctgttcgaaatgaatagtcttgaaatatgtcataaagtta

SEQ ID NO: 33764 - DNA, 201 bp, Homo sapiens
gactgataaaaccactgctcattacttggttcttaaactctccctcaatatagctgtagggacatgcaaaacaaaggctggctcattaataggatatgtcyagagttctgctttagaaatcataatgtggacatcattgatttctctgatgctggaagctgctgctgcttcttcatctttatcttctcctccctgtgtatt

SEQ ID NO: 33765 - DNA, 201 bp, Homo sapiens
acagaggatgaaaagtctgcttaaattataagctagctaattgcttcttcagttgaagacctaaatgagttttaaagtgaaatgcatatctctaagggctwagtagccaacacaataggcaattgagataggaaagactaatttagaaaaggttgttttgttcgtttttctttttccttccctcccttcctgatttcccat

SEQ ID NO: 33766 - DNA, 201 bp, Homo sapiens
atattcgtaatcaataagaacacaaaatatggaatatattaactgagttataaaaatgtttgtagtatagcacagaatgaaaaacacagcaaggtatgtayggtttaaagtgtaatcaattttgaggttgtatacaaggatataaatgataaatacaagtagtagcatttttagtaaaggctgttacaaaatactgtattt

SEQ ID NO: 33767 - DNA, 201 bp, Homo sapiens
tccagtatttaatttggttttgatatttccatcatggccccttttctcctttgattttgtcattctgtagaagttgataatctgtattatgatcaacaagscatattgccatgactgtaggaatcaccaatttagatatccaggcttcctaaaatataagtaagtcagatttagcattactgttttcctgaatgtaggagt

SEQ ID NO: 33768 - DNA, 201 bp, Homo sapiens
ctataccattcctggaggtagtagctaatagaatgatccaagtttataatttgtaaataagtagacatcttttgaggcgtatgcccttaatttttctaackgatgaaagcgtacttccatcaactcaagacagttcaaagcagcttggagcctcttggattttaaaaagactctgtggcctctgtctctcttggttttcag

SEQ ID NO: 33769 - DNA, 201 bp, Homo sapiens
ataattatcctgatttcccaggcagagaaactgaggcttagagagttgaagtaatcaactgggtgttaaaaagctggtaagtggcagagcacttattggcrctaagactgtttctcaggaccttgttgtacgagagtcaacgataagacgcagaacgtatgtttcatttttcttgggaaggatctatctcactcatctgcc

SEQ ID NO: 33770 - DNA, 201 bp, Homo sapiens
gccttcctgtgtctagcaagagggccaggcacataaaatacacatggtacaatctgttaaaaggcatgaaaaagaaacagtcattcatatctgttcgtagwagtgggcgtcaagattttggggcactgagatctatgcatgttgtgggcccactttaagaaaaggagtcaaacatttagtgtggaatactggaaggggtcc

SEQ ID NO: 33771 - DNA, 201 bp, Homo sapiens
gttttctgttaaagggtcagttatagataagtatgctcccttgcaatgaaatgaacccactttatcaattttgaaggaatcaaaattaacttgaatacatkgtctttttgcatatgtatgtagtgctttgtataaacatatgaatttgtaggagctgctcttaatgattattactgcataggctggaatagaagcaaaatt

SEQ ID NO: 33772 - DNA, 201 bp, Homo sapiens
ttgctaattttacttttcctagataaaataattctctctcccaaaatgaaatacaggaagtggaccaaattgtgtcagcctgaaagaagtgattgagtttscggaagctgtcctgaagtcgaggttctggaagatgggtggggtggggggaagcgaatgtgaagtgccattgcatttgtctccatttctgtcccagttaca

SEQ ID NO: 33773 - DNA, 201 bp, Homo sapiens
tgactaacaccttatagatgaggttcccttagaaccaaagatgccccatgaaactccctaggatgaatgttggaagtccttccaactgggattcccagccrgaaaggaaacagttcatctgactacagggtttaggtttacatgtactttaaaaaaaaaaattaataaagtttatttttacagtaattttaagttcacagc

SEQ ID NO: 33774 - DNA, 201 bp, Homo sapiens
acctttccttatcaaggacgtacaaggtgaatagctgggtgataatatatggtcccatgatcatcaaccaagcaccaacggaagccttttggaagtgcacrgtattgtttaacacacaaataactcagcgtttagtaactttcaggtacaatcagtctattttaaagggacctcatgtgttattcatgtatgtgcacatgt

SEQ ID NO: 33775 - DNA, 201 bp, Homo sapiens
ctttcaggtacaatcagtctattttaaagggacctcatgtgttattcatgtatgtgcacatgtgtttatgcagttacctttgtcttcattgatttggactyctttggtgctcgtaattggtgaaattctcttgtgatcattgttgtagttcccgcaaatctatttacggttttcacaaggaggtcacgaacatgcgttgtt

SEQ ID NO: 33776 - DNA, 201 bp, Homo sapiens
atcagtctattttaaagggacctcatgtgttattcatgtatgtgcacatgtgtttatgcagttacctttgtcttcattgatttggactcctttggtgctcrtaattggtgaaattctcttgtgatcattgttgtagttcccgcaaatctatttacggttttcacaaggaggtcacgaacatgcgttgttttcaatgctggg

SEQ ID NO: 33777 - DNA, 201 bp, Homo sapiens
ttctcgtcccacctccccatcactcctgactacttgaaacacgacttctgtcctcagaaggcagcagtgttccctcctcccgttcatttttcattttcccrttgcttaaaaaaatcaagcatatgtttgcagtcatcactgatgttctgcctcctcttctaaagttatagatgagtgccaagttggcagagcatgtagaaa

SEQ ID NO: 33778 - DNA, 201 bp, Homo sapiens
atctgctctcatttcattttcactgaactgaaaataaggtaacagaccctcaggtctacctataagtaccttccaactgttccacttttgtaaatttagtkcagataatacatatgctgaaattcctatatcccccccatactccagatcttcagtgtggaatttaaatataattccttattgtaaaaaaaaaaaattttt

SEQ ID NO: 33779 - DNA, 201 bp, Homo sapiens
catttccttggctgaacgccagaggagagaaatgatccggcaagaagacacaccattccccgtcagccccttcccgacccttgcacccctggatcttctgstgagtatcggattggtctgcgtccaagagctcctcgcttggccagcaggggctgcctggagaaggggaggacaggcttcgagttttttgggtagtgactt

SEQ ID NO: 33780 - DNA, 201 bp, Homo sapiens
gaggaaacacagtcttactgtgccgtgtgctgagcgcagagccattctcagcatcctgccttgattaataaggcgtgaaagatcctccgaattcgcacctsttcagacaagcttgtccaacccatggcccccgggtcgcatgtggcccaggacagctttgaatgtggccccatacgtatttgtaaactttcttagaacatc

SEQ ID NO: 33781 - DNA, 201 bp, Homo sapiens
ctgtttcctctctctccttggtctctgtcaaacctaccaactcttttcaggaatgcagatatttaattatcttctgctgttacatctgcatcatgtattgsctggctgttcaaaagtatcctctctaggcaaataacgagatttcgccagcaggatctcccgttaaaggcgtgcatgtgtggctttgtagacacgtatgtg

SEQ ID NO: 33782 - DNA, 201 bp, Homo sapiens
gtgagttcatttgttcattcagcaaataggacttgagtcccctactatgtgcggagccttaaaggatgagaaagatttctgggtgggacttcaatgagacycatttcgcaggttttcatgttattatgtatatgtggtaaataattaattttttcacaagtacttgcactagtgatgctaaaataagcttgactggcttgt

SEQ ID NO: 33783 - DNA, 201 bp, Homo sapiens
atcatttttggaaggagacaggatatgaattgacaaattaataaaataaattatacttcaaagatgctaaattatctcttctatgtaagtaggaggctctsttttcagatgtggaatttgtaggagcttgaatattctcaagagagggtatgggcaacatttgataaaagatgtaattattgggtcgtaggaaataatgat

SEQ ID NO: 33784 - DNA, 201 bp, Homo sapiens
acccacccctttattcttggttctctcctatattttgacatttgaagcatccacagaaaagtaatagaatgagcaattgaaaatcaccagaactgaaattrtttccagctatgtttaaatatgaatgtcttgttcgacgcttcgcatatgtatttatggctgtgtgatatcattatggcatcctaatgaatgtctactgaa

SEQ ID NO: 33785 - DNA, 201 bp, Homo sapiens
tatggctgtgtgatatcattatggcatcctaatgaatgtctactgaattatgtgggattcaacaggggatacaaatggatttgaattctgtaactgtcatwttgtggtccggagagggtggaaactgaagtatccctctgcgtcgccacatctgtcaaaagtcctcagcgctccccgcaatccatgtctggtggaagcgcg

SEQ ID NO: 33786 - DNA, 201 bp, Homo sapiens
tatgtgtggaccacagagatggactgaaaagagaagtaacagtccttggtttgtattccagcccccaccttcctatgtctttgagcttggtaattagatgyttggagcttcagtttccccatctgttggatcagaacggcagtatgtgctctccagtattttcataagagtcacatgaaatatgtacctacagagtctatc

SEQ ID NO: 33787 - DNA, 201 bp, Homo sapiens
aaaacatggaatcattctacgcatgctgttctgtattgtagtatggttttccacactgagaacatactgtgaccatgcagtcatttcccagatggaacttwttgagggacattcacttagtttcgaaaggtttctccctccactcccatcccggccacagatagtgatgcaataacatccttgttcgcatgtccagtctga

SEQ ID NO: 33788 - DNA, 201 bp, Homo sapiens
aatggatttttatcattctgatggattacggtgaagagagccaaagtcttgatagaaacactcaacgcagtgaattttttagatgtaaaagtggatggtamttaaggatacgcacattagaaggagtaatttgaccagcccatcacagtattaattgattttcatgtctcgaagacttctgatttcgttttcgaggctgga

SEQ ID NO: 33789 - DNA, 201 bp, Homo sapiens
tggccacccctgtaccacggccaatgattcaccctccctaaatcccagggccagatattagaacatctgtgatgaggactgattttctgttcgtggcctcyggaagtccagtttttctgagctcaggggagccttggttgtatcttataggcaagagacgaatttacattttgccatggtgttaacaagcaaaagaagaca

SEQ ID NO: 33790 - DNA, 201 bp, Homo sapiens
tatttcactagttccaaaagagtatctctcaaaatattaggtagtatttagtcaacactttaacacataacttgtttttttttttggcataagaagcccawgtgaaaacacagttgaccctaagcctatgaaaaatgacttgtgtgtgggactggggtggctcataggagaaggaggatattcgtctggatttttactggt

SEQ ID NO: 33791 - DNA, 201 bp, Homo sapiens
gtattttattaacatgtgctactatacaaatacacaattcacttaggactctgtttcgtgtggatcacatgggagctttcattaaattgtggtgattccartgtgagtggttatcaagtcaacatcaaataacatgaagtgtgttttagtcggcaaacatcactttgtaattctctgatgtgtttgggttgattcccttct

SEQ ID NO: 33792 - DNA, 201 bp, Homo sapiens
ggactctgtttcgtgtggatcacatgggagctttcattaaattgtggtgattccaatgtgagtggttatcaagtcaacatcaaataacatgaagtgtgttktagtcggcaaacatcactttgtaattctctgatgtgtttgggttgattcccttctttctgctctttttctctttataaagtaaacatttttattgcaaag

SEQ ID NO: 33793 - DNA, 201 bp, Homo sapiens
accttttcttccaagaggaaatgtggtgctgagccccccttccactggctgtgacaaagaaggacccctcatgtgggggcctaattctagtgaatccccaraggtacatgttgaaatagggaaaaggcccaggtgaggctgtctatgtaatagagaagatccattgcaaaatgaaaatatggggttctagccaggggcagg

SEQ ID NO: 33794 - DNA, 201 bp, Homo sapiens
tcctgagaatgttgtgaagaatatatcatccagtcagagtgaatcagcttgcccagtgcttggcatatagctgctcaagaaatattaggcattctttgttrttataaatcccctttgtattttaaaatcctcatgtatcactgaaacaaccaactgaaaaccattgagaggctcatggtgaaagaagacagacagtgtaat

SEQ ID NO: 33795 - DNA, 201 bp, Homo sapiens
gtgtaaatgtcatgtagattttaaccaaaggttgattggagggtctgagtttctcagctaaatgaaggcatgaggactgtatccctcctgaagggtgtgaycagttccatgagaaagaagctgcgagctgtggggcatccaagataatgtaatctgccccggggtcctgtgagggactggccgacaaggcaggctgaatgc

SEQ ID NO: 33796 - DNA, 201 bp, Homo sapiens
agctaaagtgtggtctctgatgctgatcatgactatgaaaagggaaaatggaggagaatgatgacgaaggaggaggaggaggaaaaggtgacttgcctctrgctgatgtggattatttctcttttttaatttccatgtctgtgtagcttcatcatagatctcagcttaaggacaatgaaagtcgtttattgagtacttagt

SEQ ID NO: 33797 - DNA, 201 bp, Homo sapiens
catgtagaatctgaaaattaggagagagaggcaatcagaagaagacagagtggtgttgcagggacctgcagtcagcctagtcccccagtttgcgtttgaayttggtcccagattttttttgtttttgttttttagtagttaaagctgagagcaaaccacattgcttactattgtcagggaatgaaaactatgcaacagaag

SEQ ID NO: 33798 - DNA, 201 bp, Homo sapiens
gtgaattaatttacttgcatatattggccaagatctagcataatctcttaatattcaatgaataaaaaattgagttttgagagcaaatattttggtaggamatagagaactgacactaatattctctctgactataattgtaaaacagtagatgtctttcaccaagcgctaacattatattaattattaataaaatccaac

SEQ ID NO: 33799 - DNA, 201 bp, Homo sapiens
aatattcaatgaataaaaaattgagttttgagagcaaatattttggtaggaaatagagaactgacactaatattctctctgactataattgtaaaacagtrgatgtctttcaccaagcgctaacattatattaattattaataaaatccaactccttaataatacaatcatagttaccatttattgagagcactcttctga

SEQ ID NO: 33800 - DNA, 201 bp, Homo sapiens
gtcttagtctcctgagtagctgggacgacaggtgcctgcaaccatgtctggcttaaatccatccttaaacaagttcaatgttttatttccttcagataaartgagagtggagagaccacagtgatgcccaggaatagtcatggttggcgattaaatagccattgagtctctattctgaaacaggcaccgtgttcatttgct

SEQ ID NO: 33801 - DNA, 201 bp, Homo sapiens
ttttgcccaataactagaatgctaatgggacttagtgtaatggtttagttcaggtttgttggtttgaaaataaacgccttcatttcaatatttgccttttrgctgcagcccgttaactggtcacatgctgtaacctcattaacatcaaggcttaattgtaagttaatgtgcacctagtttttgtaaagaaggtttctatct

SEQ ID NO: 33802 - DNA, 201 bp, Homo sapiens
gcccccgccccgtttctcagatcacacaggcaggctgaggagcgcttaacaccccagcctcccatgaagcatcctgaaaaagcagactttgtcttcctccrtcagctttgtttgtcctctgccgagactccagggacatgattgctcttcattttacgctcgagatcaaaataaacagaaaccactttcagctttcccgtt

SEQ ID NO: 33803 - DNA, 201 bp, Homo sapiens
gtggccaatatacacggctcaaagttgaccatgatagagaacctttccctagaaggtctgtgagggaggaggcctgggagagacagcagggtgaccagagyaagtgaagtcaccgaggtgccaatgagtgtggccctgcaggtcctgcagacccccctggtggcagtattggtggtcacagctggcaaagggaagtgtggc

SEQ ID NO: 33804 - DNA, 201 bp, Homo sapiens
agaaaagtgctgaaggtggcctgccctaaggcagtagcactagagcagggatggggaggacttggtggccagatgcatgtggacatgatggaaagggaagrgaagaactgtcaagattttcactatcagtggtataagccccgtagtaatatgcctagtgttccattattggaacactaagtatgtgggaattatttatat

SEQ ID NO: 33805 - DNA, 201 bp, Homo sapiens
catcaccaaggtctgatcgtgaaaattcaaaaaattgcaacctgaggcataaatgggttttaagctccatacagtaaaacctagcatatgaaaacagttckggctgatgggttggtagaagtgatagatatagatacatacatacacatatatgcacagtaatagatataggtaaagaccttgatatatgtacatatattg

SEQ ID NO: 33806 - DNA, 201 bp, Homo sapiens
tgactttgcccacaaatgccagaggaggactcttctgagccatgccaataagaaaaatgagaatgccagcttaaataaatgttatcacaatctctgcagartcgtgatgtctccgattcttaaaagtgtctactgcagggtatttattattctgtgataataataaatcgctgcttatgaaatgcaaggaatcgagtgtca

SEQ ID NO: 33807 - DNA, 201 bp, Homo sapiens
ggcctttgtgttgtcacattcttctgcctagagtatgccttttccttcaccaaaccaagtggctctttcggaagacttgcctgaatcctagaccccttctytctacaaccttcagtctgagttgggtaccttgcatcctcctttgttcccatactaacccctacaaccatggtcattttgtggttatctgtttaattctct

SEQ ID NO: 33808 - DNA, 201 bp, Homo sapiens
tatctcaaaaacccatgcatattctgcatctactctgaattccgcagtgttgtgtgttactatacgatctagtgttttcgttgcttacaagttagattcayactccaggaatgtatctgttcccacatcccctgatgctgagcataccagagttaagggaggcaagcaaggcccctaacctcccaggttcatggaggtacc

SEQ ID NO: 33809 - DNA, 201 bp, Homo sapiens
aaaacccatgcatattctgcatctactctgaattccgcagtgttgtgtgttactatacgatctagtgttttcgttgcttacaagttagattcacactccasgaatgtatctgttcccacatcccctgatgctgagcataccagagttaagggaggcaagcaaggcccctaacctcccaggttcatggaggtacccattctg

SEQ ID NO: 33810 - DNA, 201 bp, Homo sapiens
ggtggagatgtgcaataaactgagcaccgatagagtaccaagaacatgctttttgcacattgtttgattcatcaatcagagtggggcatggctgtcatcakttcagagttgaaagaattgaagatcaaaggggtcacgtctctgtgaatagtattagtaatagcagcagtatcgatagcaatcatagtaattaaaatggaa

SEQ ID NO: 33811 - DNA, 201 bp, Homo sapiens
cctgtacttcaaggttttggagtgggaaagttgaggaaatgtaagagatcatctctgtctctatcacattaccgacggagaagtgggataagaactatgtktgttttcacttcttctttctttagagaaaacaaatatcatctgccttgctaggtagttgtgagaaatgaggagataatatctttaaatctcctacggtga

SEQ ID NO: 33812 - DNA, 201 bp, Homo sapiens
tggttttattttaattgagttttaaagcacttctaggccatctcattgtctttatagtttaaccctttgaagttgtgactgccaacgtgctagtcttgtcrtcttacacgttaatggtaatgatctttttagatttattgtgaacctctaggaatgttttttttaaccagtaaatgcactgaaacatggaatcaaagtctc

SEQ ID NO: 33813 - DNA, 201 bp, Homo sapiens
acttggggcatcaaaacattgttttaaatatttcgtttgtagacaaggcaaagatcattttcaggttagtcctctgagaaggaacgctgggtgcagaagcrtctttggtttctctgctctataatcggcactcattatctatgggtttatacgagcagaaaatgtacagttatatgttcagcacaagtgaattattgattg

SEQ ID NO: 33814 - DNA, 201 bp, Homo sapiens
tttctacttgaattctatttgtcatcctctgtacctaccacctgccagttgctgtattagatgctgttttactcattgtctaattgaattctccaacaacyttgcaatacgcttgttatctccattttagaaacgagaaaatggtgactcagattaagaaacttgctcaatgtaaccaagtcacaattttaatattaaaaa

SEQ ID NO: 33815 - DNA, 201 bp, Homo sapiens
atcccttctcccacttttcttaaccctacaagatatgccaagattctatagcatctgaatttgaaaacctctactaattcatgaggcaatctatttgatartggcatgatttagttagtgttccttttttagagataaagcctcaccctgttgcccaggctggagtgcagtggcgtgatcacagcccactgtagccttgac

SEQ ID NO: 33816 - DNA, 201 bp, Homo sapiens
taatgcctttaacatctgctaagagtatgtcacttattgacgtagcatcactttattgagcagctactatgtaccaaacacttagcatatgctttttggcrttaggagctgaacccagagtggtctctgtggagaggtgcaggtttacccagggtggtggtagtggtgatggggtggtagtgatagtgttgatagaagaag

SEQ ID NO: 33817 - DNA, 201 bp, Homo sapiens
atagaagtaaatgagacatctctttcatctgcaccaacctccttattaagaccttatcagttacctgtagattctcccactgttgtacttgtttctccctyaaccaattgtattttagctctcaagttttggcagggttgagtctagtatttctgttgggatccggggagcatatggagtgttgtttgttattttttagag

SEQ ID NO: 33818 - DNA, 201 bp, Homo sapiens
ccactgttgtacttgtttctccctcaaccaattgtattttagctctcaagttttggcagggttgagtctagtatttctgttgggatccggggagcatatgsagtgttgtttgttattttttagagtttcttattgcggtaagtgctcaggagggaacagagggagaaggatagaggaaaagcaaagcaaaacaaaatagaa

SEQ ID NO: 33819 - DNA, 201 bp, Homo sapiens
tcaaccaattgtattttagctctcaagttttggcagggttgagtctagtatttctgttgggatccggggagcatatggagtgttgtttgttattttttagrgtttcttattgcggtaagtgctcaggagggaacagagggagaaggatagaggaaaagcaaagcaaaacaaaatagaaaagcacaaatgaagaatatttag

SEQ ID NO: 33820 - DNA, 201 bp, Homo sapiens
gtgagaggtgacatgccatgatgtggttctgcttctctgagattgtctgtcagcttttccctcagtttcacccccctttctccctttttcaagatggtttyagcacttccagacattataaccagatagcctattgctagagaacaaagcaccttctcttcctatatgtacctcttgggaacaagggaacctttccccaaa

SEQ ID NO: 33821 - DNA, 201 bp, Homo sapiens
tctctgagtctcagctgaccaagctctaaaatgagcataaccatatcagtttgtgtttcctgttacagggagaaaagactgagataactaaagtacctgaytgagtaactgctctctgaaggtggaggctggactgcttcactggacagggtggcctggggttattctagtgcagtggtagctggtgacaaaactcaaaga

SEQ ID NO: 33822 - DNA, 201 bp, Homo sapiens
aaaacatgatatccaaagtcaccctgtatggttggatactttgggtttgccatcttttcttttgttcatttgtttcatgcaatagaaacgttttgagatcstgtctggctgggttctgctaggcctgggtctacagcagtttgctgtcaaggtcttggcccttcaagagcatgtagtgtggtggggaaggtgtacatcagt

SEQ ID NO: 33823 - DNA, 201 bp, Homo sapiens
aaagtattcctggtctatgtccagctccactaatctccagactgcgcttcatgaattaagcatgaagattttagtcaatgtgctttcaaagaccaatgttwagggaatcatggattttctacaagctgagggagaaatctataataggaggaactgattttcaaacatcatattctcaagaagaaatgaccacttctggcc

SEQ ID NO: 33824 - DNA, 201 bp, Homo sapiens
ctgaaacaagacgaagatttggacggtttgctttagagtgcattaacttctttatcacattaatactgactcatatcttatttcccacttgcaataagaaraccattcaaatctttccctcacaggacaatatctttaatagcttctgtgtgtttcctatttttggctgtttctgtataaacagactaatctaatagcata

SEQ ID NO: 33825 - DNA, 201 bp, Homo sapiens
tgtggctgctttgagcttcttcctcgatcaggctggatcattaccagcctgtaccctcaaaggatgcccttagtcctgtcccctctcactagcagggattscaagcttgtaaataaagtctcccacttaaaatgtgagcagagtgaagagctggcagtgtcaaaactctgtgtccagatgttttatgattttcccttttcc

SEQ ID NO: 33826 - DNA, 201 bp, Homo sapiens
aaggtaaccaggaatgacattccaagattccattctttcctttgtatatccactcatcattcattatattcttactctgggctaggccctgggaacagttkagtaagaacaagcaggaacaaacaattagaacatttagtgtggcaaggggcgtgacaaagttaccaagagaggtaggtgagagacaggagttgttatctg

SEQ ID NO: 33827 - DNA, 201 bp, Homo sapiens
aggttgaccttcagaacggcttcctgaataatacagaagtgaccctccaggaaggcccttccactgaagctacaactggagctaagcagatggataagccraaaccacctccgttgctgtggccccatctccaccacaaggaagctggagaagggaccccagaaccggaagacaaaaaacttccttcacacactcccttgc

SEQ ID NO: 33828 - DNA, 201 bp, Homo sapiens
cctacccccaaaatgtcaacgtgcccaggttgagaaacgtgacctagctggaaggtgaacaggaactaaatgagtcagtttcagatatccaacacaaataygtcacttgtttctgttccaaaagtattataatttttgtttgagctaaaaactagttacagttcattggataattgcctttcatcccttcaatatgtgttc

SEQ ID NO: 33829 - DNA, 201 bp, Homo sapiens
agtttcagatatccaacacaaatacgtcacttgtttctgttccaaaagtattataatttttgtttgagctaaaaactagttacagttcattggataattgsctttcatcccttcaatatgtgttcccttgaaatttgcatccatgcatcccacatggcacccctattgattatttcagtgactcagaagacttcattattc

SEQ ID NO: 33830 - DNA, 201 bp, Homo sapiens
ggaaggaaacacctttccaagctccccagtgaccctggttcatcccggaaatatgcaggaaaagcattatgagcattgcagtgccacatgctgcattggtrtgttacgttatgagaactattagggctgatctctgagaaacttaccagtggtgtgtgatcggaaatcatgtcaccctctgaatgtgggttatgggataaa

SEQ ID NO: 33831 - DNA, 201 bp, Homo sapiens
ttttatttaaatgtcagatttaattaaatccatgaccagaagacaaacccaaaggaaattttcagggagctttagaattttccttttccatgttcaaggtkataaccgtagcataaaactgtcccaaccacatgcaaatgcaagcaggggcattcatcatgaaaatacagctctcaaggcggaagtgcttgttaactttgc

SEQ ID NO: 33832 - DNA, 201 bp, Homo sapiens
aggtgataaccgtagcataaaactgtcccaaccacatgcaaatgcaagcaggggcattcatcatgaaaatacagctctcaaggcggaagtgcttgttaacwttgcactctatagccaagtgcgatgatcagaaaatacatacattgaagacaccagaaaatagtgtatggattggtgattttgactaagactggaatgtgg

SEQ ID NO: 33833 - DNA, 201 bp, Homo sapiens
aatgggttctttgcaacttgcagaaccagatcttaccatttgcaaggagaatagctgaaaagatacttaaataaaagtgatcggatgaaattttaaaaacrggaatgaccaaaaagattcccagaggaccgttactggtctgcagccccccattttagggtctggcatttgtactgattatggcctgacagctcttgagtt

SEQ ID NO: 33834 - DNA, 201 bp, Homo sapiens
gactctgtctcaaaaaaccaaaacaaaggtcaattttttttccacattcatctataaaacaataaaggaaacatcctagacacttgaatcagagccctttwaattatgacttcaaaaaacagggctcgtgccacccaagatttcctccatatacaaaaaaaaaaaaaggaaaaagggaagaagcaaaggggcaatacaggg

SEQ ID NO: 33835 - DNA, 201 bp, Homo sapiens
tgtgggacctcacagaacactccaccgtccctgctaatggctgagaaaggactctgccctcatggatggggttgggggacctgttatcttcttccaggttmatcttggtttcagctgctttaaactctactttttagtgggacgcatcatactgaactatggaagcaccatagttgtcacctagttgagcttctctttgtt

SEQ ID NO: 33836 - DNA, 201 bp, Homo sapiens
gaggactgggagagatctgtgaggtcatcttgtccaccctcagccagggcaggagtattccctaatggtagagtcaagtgtttggtttggtcttgtttctratgactcaagtgatgaggcctggggacgtcccttgggaagctattctgcagcctaataactttcattctgtgatttttttttgtatgtgtctaatattca

SEQ ID NO: 33837 - DNA, 201 bp, Homo sapiens
aaggaggtcacttctgattgtcagtgactttggtgagttcttaccttgtaaaagatttacaattatttcattttcaacatagctttatcttatgacaaagktgacagaaaggaaatctcctaagttggcctacagggtgctttagaaaacatctggctgggcatggtggttcacacctgtaatctccacactttgggaggc

SEQ ID NO: 33838 - DNA, 201 bp, Homo sapiens
acagaagcatatggcagaattcatatgtgaacagattgctttttctcataagaacgctttattggaatatcaactattacagctttttgaagttactcttsctgctcttgatttaagtcctgaatcaccccactactctttttttttttccgctgcattctgctatgtatctttacatctgcttcctgcactttctaaatg

SEQ ID NO: 33839 - DNA, 201 bp, Homo sapiens
ttaagcaggaaacaatgaatgagtttttgctcctcttgccctatttgccgtgtctcttttctgtgattcgggagcacattgatacccttcttttggagcasagaagcttgtctttcatgatagaagtaggtcatgggggcggttagctgacttcatcagagagtagcatgcagatcccacctgtgaggctatggtctgcca

SEQ ID NO: 33840 - DNA, 201 bp, Homo sapiens
ttcccccttttcttcttcaggctttaaagatatcataataccatttacatttactgtttaatttttaggtctgtatttaaaaatctgtgtagtgacaacarttattcttattgtatgaacatattgtcggctggagagtattcagctgtcagacaaagtgttctctaaagtgttcagccatcagacagaaactctattgct

SEQ ID NO: 33841 - DNA, 201 bp, Homo sapiens
gatttgaacctacagttttgaggcctgaacctgctatgcagtgctttcttcctgatagtgaaaccactgtggtcccaaacccacagggctctatttagatktaaacaagactatgaatgtaaacagacacagtgcaatgccagatccagagcaatcgaaggtcatagtttcctcatccctcgaagctgccaccttgcaaca

SEQ ID NO: 33842 - DNA, 201 bp, Homo sapiens
tatcacttggaatgtggagagtcatttccattagggaaccaccaggaatcttggcaacttagcagccacaggagatgcagaaactgagtagtgatttaaamattcagatcactttgtttgttcccctagaataatacattattatcattaacaaagtaactcaacttacagtatcaaatcaactgcagagccattgatatt

SEQ ID NO: 33843 - DNA, 201 bp, Homo sapiens
tagcctcagatataagcttaggagtcctgaatttatcatcaatatttatatcgctgtttggcccctaacaccttccctatgatagccctaattggaatatmgtaaatgtttgttgcatgaatcaacctatttaacctgtgcgtccttaaatcttacggtctgcgggttgacatttctagtgaagggagacatttctttacc

SEQ ID NO: 33844 - DNA, 201 bp, Homo sapiens
tgaggagacagcagacagttcctctccctgctgctggcctcttcatcttctcctggcgtcaccacggccaccgtgatgcctggctcaagtactagttctaygtcaatgatggtaccaatggactctaactttagaatgttgttgactgaaggcccctgccccctgccttgctttaggtggaggatctggtcaaggctttgt

SEQ ID NO: 33845 - DNA, 201 bp, Homo sapiens
tttctctcacctccgaataggtgggccttcccaatttacctgtgagaaaactagtgtgccacctcaagcgattctggcctctgttgactgtctgaaccctstgttttgttgagtggtgcagactagagatgaagacagggattcggcttcgcttgctttatcaagggaatgttcttgggacaaatgtgtgacaggtgagga

SEQ ID NO: 33846 - DNA, 201 bp, Homo sapiens
tcatacaattcccctgcctcagaatcccaaagtgctgggattataggcatgaggcaatgtgcccggcccacaatggttttcatatagctattgtgtattgmgttattgccttagtcacagaagcccataaaaaacagattccaataaagagactaggtttgcagagtgatgagtggggcccttgaaataattacatttagt

SEQ ID NO: 33847 - DNA, 201 bp, Homo sapiens
ggcatgaggcaatgtgcccggcccacaatggttttcatatagctattgtgtattgcgttattgccttagtcacagaagcccataaaaaacagattccaatraagagactaggtttgcagagtgatgagtggggcccttgaaataattacatttagtgggttatatgtctatttttttggtcgttccttgctcatctgtctt

SEQ ID NO: 33848 - DNA, 201 bp, Homo sapiens
gatttcccccatctggcagaaacttttacagagtgtttgcagaagagaagcctgtaaactctggagtgtgtcctgggtggtttgtccttgggccactttaktccctcaccgatcccttccaaaggccatgagttcccagtcagtcatttccctatatcagtatttattgttttaatcaattttccccatcccaagagaaag

SEQ ID NO: 33849 - DNA, 201 bp, Homo sapiens
ctcctagtcctaatattaagaggtaggaggtagatagagattgtcccttaagccacattccattcttcatatttttgtacccattagagtagtgctgatcmtttgccttcattgctggggtcccctaaatgcaacttctcatgctgccaatttagtcctggccctaggaagacgtaggtgataggatagaattcaacaact

SEQ ID NO: 33850 - DNA, 201 bp, Homo sapiens
ctgccaatttagtcctggccctaggaagacgtaggtgataggatagaattcaacaactagaagccatggtttcctggttggatagacttcctctgccaccrgaataaaggaatagagggttcctcactgtgccccatagctgcaaagtcacaggaagcttgcagcaggccagtggtaacctctgagtgacttctgagttcc

SEQ ID NO: 33851 - DNA, 201 bp, Homo sapiens
cacaggaagcttgcagcaggccagtggtaacctctgagtgacttctgagttcccagagctaggaccatgacttttcccctggattcttaagtacccggctraaattgtgtttgccgaatgaaagtgtgatcctggaggccatgttgtttgtggttcatggaagggtgcttgttcagcttggtcaaagcaagatggtcatac

SEQ ID NO: 33852 - DNA, 201 bp, Homo sapiens
cagcttggtcaaagcaagatggtcatactgggttttggtgcccagacgttcccaacactcgcagcagagggcattaggatcatgtttagccaacaattttkgaggcacccaacagtgattggatgtcatgtgctttcagaaggcacactacacatcttcggttcctccaagctctaggaaagggttgtggaattgggttgg

SEQ ID NO: 33853 - DNA, 201 bp, Homo sapiens
tctcctgaaaactccatttcttagagagtgagctccagcaccatcagcctgaagttgaagaaatgggactcaggaaggctggagtcttcaggcgttcttasaatgctgatgcgactcagacggctgcctgcactgtcctctgtgcttctaagtgaaattacccgtcggggggctcctgagagttaaatcaagcagcctctc

SEQ ID NO: 33854 - DNA, 201 bp, Homo sapiens
taccatttattcagtgttggccagtgacgcctgccactgcattttattgatgaagaaatggagatctcaagaggtaaaaaaaactgactataggagccaasactagtttagagtggagtttgaatatgaacatgcctctgtctgtgaaagccagtgtcccttcagccaggatctttcctggaagaactcagtattaaggca

SEQ ID NO: 33855 - DNA, 201 bp, Homo sapiens
ttagcgtttgggggtcactccatagagaggggtttgtggaaatcctttttttttttttttttttttttgcttctttctgtggatctgtttggaaatgtaasattttaaagcccttcttggctggaggattttttatggtaaacataaaacgttcattgaaacattaaacattttacagctgtttttcagcacataaatttt

SEQ ID NO: 33856 - DNA, 201 bp, Homo sapiens
ctctttttccccccccttcaaatagttccaagaccagagttgagggtgggtgggtagagggctagtttacagataaaatggttggtgtagatcatctagtktggaaaaagcacattgtattttaatactaggaacgtgtgcatgccagaaacctgccaaggaaaacactcccgctgctccttccagccctgactccagctg

SEQ ID NO: 33857 - DNA, 201 bp, Homo sapiens
ccaggtctctcccctaacatgtggggattacagcttgtattacaattcgagatgagatttgggtggggacacagccaaaccataccactcatggcatctcrtttttacagagtatatgtgttttcagattttgcatgacattttaggataaatgtgatgaaaatgaggaaaattgggaatgaagtttaggtcagaaaagtt

SEQ ID NO: 33858 - DNA, 201 bp, Homo sapiens
cagcagtccacgcttgggtggaaggcaggtttcacgtaactgatttaccacttggtaaaggaacgaggtgacagcaagaccacaaactaataaatatgcckgtattgacataatgtcggacctcagtatgattgatgcatgtgttgttgactgggatgtcacatgttcaggctgtaatcctggtctcagtatgactgtgag

SEQ ID NO: 33859 - DNA, 201 bp, Homo sapiens
tcaatcattgataagatgtactgttattttatgtttcactaagagtgcgaagaacattgttaattatacaatgatccaaaaatgtcttctctctcagaatrtattgttttatatctattacaaaggctcttttgacttaggcatagatttctcatacatcaggccatttctatgcctgcctgtgaacacagggattttgaa

SEQ ID NO: 33860 - DNA, 201 bp, Homo sapiens
gcacatcattcaatcactcaacccttgtcataggtagatactattatcctccttttatagatgaggaaaccttggcttagaagggataagctcaagttcasaggcagaaaagagacagccagtcaagccctgactccttttgtgaccctgatgagattacaggtcctcagtctcctcattgtatctgaagactaaagaatc

SEQ ID NO: 33861 - DNA, 201 bp, Homo sapiens
taaaaataattcaatactagtatgtaaaactaaaaacaataaccaagtgtgactggctgtctaagaattaagcaaagtaagatgaagtgtcttttgctagyaggcgctctcagcaaaggagataaggctgcagtaattctcttcccaccttcgatgggcaggtgcaacctttggctgcagaaattctcacttcccagcagc

SEQ ID NO: 33862 - DNA, 201 bp, Homo sapiens
taagatcaatataatttaaattttaatcatggcagtgttcaataactggcttgcatattttttgaacagtcatcagctcttgtgagccacggttggccagytcccaaacaccatgacatacaacttgcaggaaaagctcattttccagtttttccccctccagctgtaggggatatattttcgttaattcctgtgaccata

SEQ ID NO: 33863 - DNA, 201 bp, Homo sapiens
taagacaacttgcaagacttattaaatgactgatttccttaaaagaagtacgtcaggtgaagggcagatagaggtcaacaccatagataaatctttacackccagtggactttgattcacatcatggctccttctcttccttgctgaggcttttgacaatttcaaatgctccctgaacctcagtttcctttgccacaaaat

SEQ ID NO: 33864 - DNA, 201 bp, Homo sapiens
agagtttgcagtgagccagattgcaccaccgcactccagcctgggcgatgagtgaaactccgtctcaaaaaataaacaagaattgtgtctggcctttgtgrtagttactcaacaaatcatatctgtgattgttttggttttaacaataatggtttttaaaaaccgtaggtgatcacatactacgcagaaagggaagcagtt

SEQ ID NO: 33865 - DNA, 201 bp, Homo sapiens
tctttctccctctgggggactgagacatgattaacttgcaataattgtgactccctcattaaaggagagctgtagcaagggaagaaatcattgagactgawcaagacatcccgtgctattttttttttcttgcatatcagctgtgtgggtacctcttgttcctctgtccttcaggttagtaaaacgaagaacagttgctga

SEQ ID NO: 33866 - DNA, 201 bp, Homo sapiens
gggccaccaaggcactggtgcatcccctgtgagcctatttggctcctggcggtgtttttgttgccctggcttgcaacgtagcctgattgttctaagtaaayggcagagcacgcaaatcaaggacattggcaataaaccaggaatgcactgtttccagccacgggctatccagggaattggggacagtctgtaatgtatctt

SEQ ID NO: 33867 - DNA, 201 bp, Homo sapiens
caattggagaagggcgccttctgttatgttcttagctcactaaaagtggttaatgatgagaaggggtgggtcaatgacaagaaaagtggagaagatgagasagacaaaactgcaactcatcttcatggcacactggtgagtgggggagtgcaagaagtttaggtgcaaaggacaatggagtgaacatcttggcttggttaa

SEQ ID NO: 33868 - DNA, 201 bp, Homo sapiens
aaactgcaactcatcttcatggcacactggtgagtgggggagtgcaagaagtttaggtgcaaaggacaatggagtgaacatcttggcttggttaacagaaraaaagaataccaacgccgtctattttcatatccctttctattttatgtacatatttatcaatatactttttgttccagaaataaatgggaacttaggcac

SEQ ID NO: 33869 - DNA, 201 bp, Homo sapiens
tgcaaacgtccatacacacccatgtacacacagacacacacacacatgcatgcgatctgtaaaaagtcacaaaggccaaagttttaaaggaagaaaataamaatcacctgtagtcctatcattcagagataaccactgtatgtttatttacattagttttgattacattagtttagaatgaaattttaaatacactagtat

SEQ ID NO: 33870 - DNA, 201 bp, Homo sapiens
agaggggggatttttccccccatggcttcgtccttattcttataacctgtatgcactgctgaacctgctgaataaccatgtcacagtggcaggagagggamtgggtgaacttgagcctcgatgcctggattaaagccttgtaatgatgtttgcaaagcaccagggtgataactgaatggttggcacaggcttcgatgaagc

SEQ ID NO: 33871 - DNA, 201 bp, Homo sapiens
aatctgtttttccttctgtctgttcttggctatatggaattcactttgcctctcttcccgactcttcatatcccttatctcaaggtgagtatcgtcagaawcccggtacatttcaccagccaccttttatagaagcttagaaagatggaggcaaacccataaacaagacttggtttttctaagccacagtggcaatttcct

SEQ ID NO: 33872 - DNA, 201 bp, Homo sapiens
ctaagtacttgttaaggcagaaaaacgcagataagaaaatcgaagttgagggcaaggagctcatctttcacggtcatagacctcagttgcaacatctggamaaagagctggttgggcatgccgggcaggcttttgtgacaatgtaagagcaagtgaagattgcatctcagtatgagacaccgtaagagcttgataaatggt

SEQ ID NO: 33873 - DNA, 201 bp, Homo sapiens
tcacccgtacctgtggaaattagactgtcacctgcttttagcatcctgttttctttcgtgtttgtaatgaagccctccgggaattatgcgattacaaaaawgagttacaaatcctcattcggtatacgaaagtatatagctgctttccttctctgtttaaatagtctacaaaacaagaaataattagtcaagcactatcgg

SEQ ID NO: 33874 - DNA, 201 bp, Homo sapiens
tagttttctccgttttgtgacttatttttaattattaagaataagtgtcataaagccaatactttctaacatgtgtatagtatgttatagttttcaaagtmtttgacaattatacctagggagccaggacagtatttgtatcatcatttcattgttcctggaaaacaggttcagagaagttaagcgacttgcccaaaatag

SEQ ID NO: 33875 - DNA, 201 bp, Homo sapiens
tgatttccaacatagagttctgctaaccaaaattcagagaaactagagcctcagtctctgatttatttgagcaagttgcaatttggtagactggagaattkatgtaaatagtttttgcagtttccatagggataactcaatacattaatatctcacgaatggcagaagatgaagggggaaagttttttttttaactgatag

SEQ ID NO: 33876 - DNA, 201 bp, Homo sapiens
agtgatccaccctcctcggcctcccaaagtgctcggattacaggcatgaaccactgcgcctgactgtacttttttttttttaaagtatacccatacccatwgtacacatttggtattttttctttaaaaaaaaaaagcatttactttttgcctcatgaatctctgagtacattttgtgcattctgtattctactttattta

SEQ ID NO: 33877 - DNA, 201 bp, Homo sapiens
tagtggttttccagatgtgacaaaacaaaagaagatttccaaatcaaaattcccatttgcctttcgggatgttgaattttctccacatttgtgcaattaasagttttgctgagtgagcttaggactctgtctctttaagtgtttaacagtaattggttcatgtcctggtgttcattgaaaatcctagacatttcatgtaaa

SEQ ID NO: 33878 - DNA, 201 bp, Homo sapiens
agccagtctttccctagaccagcatctgagcgtgccttgtctatgggccacctatactattatttactgatgacttcctcattcactttctgttttttatstaaatgccagccttagccttgttcaaggtaacagtatacaggaaatcatgggtttcgagcatgttttgtcaatatttagtaaaatgcgttcatagctatt

SEQ ID NO: 33879 - DNA, 201 bp, Homo sapiens; identical to SEQ ID NO: 4868

SEQ ID NO: 33880 - DNA, 201 bp, Homo sapiens; identical to SEQ ID NO: 4875

SEQ ID NO: 33881 - DNA, 201 bp, Homo sapiens
gacaggcacttgtaaatgttgagatgccaagggggaaagaattttagaatccagatccgctttggtaagagtggccttcgagcctcatgtattctctgttyagctgttaagattgttattaaactttatggaccataaaccccacagaaacaaggaggttgaacaaccatgctattacacaagtgtcaaaacaggagctgt

SEQ ID NO: 33882 - DNA, 201 bp, Homo sapiens
agggtcagagaacttgcccagggtcacacaattagtagatggcagctcaaggggtttttgcctgcgtcttcacccaaagccactaacacgggatctgtcarttgcattgctggtgatcaagaaatgccagctcctccgctcttccctgagtgccttgttggagacaaaaccagcagggttatatccccagcactgtaattt

SEQ ID NO: 33883 - DNA, 201 bp, Homo sapiens
tagtgtggcagtcaggggaaaacaccttgtagaatttcatttcttatcatttaatgtcccctttaattctcatttaagttcccctctgtaaaaggcagtcycttcagctctcataaaactttatggtctttacttgtgattaggcaatggtaaaattgattctctaaaaccaacttctagtcaagttatgtaattagccaa

SEQ ID NO: 33884 - DNA, 201 bp, Homo sapiens
aagatatacaaggttctccctcaagaggtcagacgtattatcattggttagatgccgtatctttaaaacaccatcagcttggaaaacactatccattagcragagatcagagcaagagaaacctcgaagggtcgaacggtccattctgagggctccacaaagaactcggcatcccagaaggatgattagccttccatctct

SEQ ID NO: 33885 - DNA, 201 bp, Homo sapiens
aggtctgagtgtttttttctttaatgaattaaccctttggatttcagccctagcttttgcttcccacatctgacatcctgccctacctcctgccagaaaasattttgatttcgatcatggcagttgctgtcgctgaggtaatatgaggagatccgagacctcatccttgcagggagtgggcttgagataattctcgttaca

SEQ ID NO: 33886 - DNA, 201 bp, Homo sapiens
atcccataactctattttatttctctgtctagcacttatcactatctgatattttctgtctatccatccgtctattcattcattcattgctaatttattastattgccttcccatgaactattagctgccagagagcagggacctcatctgtcctgtccactcatgtcttcagcacttagaacagtacctggcatatagga

SEQ ID NO: 33887 - DNA, 201 bp, Homo sapiens
cagcgctttctactgcagggggtatgatggatggagaccctgtttcagaggggtttcctttagataaaacaataataccatgctttcaagaagctcgttcracagctgtaaagctatgattaatcccccaaaagtcaaacatgggaagactggcaagatgagattattcactgggtataattagccacaattatcgctaaa

SEQ ID NO: 33888 - DNA, 201 bp, Homo sapiens
aagcatattaatccattagtaatccatttggatttgggaatacggtcatatactgtttggtacaatatgtactaaacctggtcctggaaaattaagtggaratataggtttaaactactggaacttcaaaatagcttctcagtaattccttctcagcaatcattccaattcctagatttaaaaaaatgttgatatatcaaa

SEQ ID NO: 33889 - DNA, 201 bp, Homo sapiens
gtttatgattggtccctgattgcctcacatcttgcaaagaatcctcttctagaaagcgttcttgcagttagattaacaagcagatatactgaactggtgcrtgaatgaataggaaatatcccagttgcaaaggataaatctatcatgtagtggagagcgtgttcaggcaaaacatttggttctgcggtcgcttggaggatt

SEQ ID NO: 33890 - DNA, 201 bp, Homo sapiens
gagagcgtgttcaggcaaaacatttggttctgcggtcgcttggaggattgggcccgtgctataattaatgccactagcagtaaaaggacattagggatgtygcgcatgttgattatttcttcattttgtttatccaagtttccccgccttggaagctccgtggccattgccaaagaaagccctggagacagagcgttagcc

SEQ ID NO: 33891 - DNA, 201 bp, Homo sapiens
gtttcctttcccaggtttgaaaaggcagttaatcgccttacaatgaaattatatttttaaaaaaggtatcataatcaaataaaagaagtacttcatgtaartcaaggattgtgcttttactactattttttctttttttgtaatcatggtggttctttttgcccacttatttaggccttaatttaattacggcgctgatta

SEQ ID NO: 33892 - DNA, 201 bp, Homo sapiens
gctctctgggcagtgggatgggggtaaagcaaggaattaataaaaacccaccagaatacattatttcagacaatcaaggagagcgttacattttaaaggtrcttcatctcagaaagtttgagacatacttttcacacgtggcatgaagagaaaatggaatggaatgagcactaatgaggaccttgaacttaactaactgaa

SEQ ID NO: 33893 - DNA, 201 bp, Homo sapiens
cgtacacatctatgtaagcactctgaattgagtgactctttcccaaagatcatactgggatctttggaatgaatggcgggtcacccatccaattgcttttrcggagattcgagcatgtggggaatgcaagtcacaatatcctgcaaaagccaacttgagacctcctaggactgcactgctgcttatgacactgatccttag

SEQ ID NO: 33894 - DNA, 201 bp, Homo sapiens
tctctgtatcaaaaagatcaaaatcaggtttgaaagtctgtactgtaactaaaaaagttttggggtttgttttgttttgaccaatttttgtaaatctcttytgttactgtttatatacccggccacttctgccaaaatatgctggccttttagtcttttggttttttctctcttttggtttgttggcttatgttcgctgct

SEQ ID NO: 33895 - DNA, 201 bp, Homo sapiens
aataaatccctgtggaaaaaaaaaaaagagggggaaaaaggaatgcacattagtcttccattaaaaatagatcaaaaaagtacccaaaagagaaaaccccrtaacaatgaaataaattaggataatccaactggaggcctgcaaatgagtttgctaaatgttatattttctcaagccacttagatttttaactccctgttt

SEQ ID NO: 33896 - DNA, 201 bp, Homo sapiens
tcaatagaattgcttttgtgggatgatgagtgtgttcagagtcatactcagcctaattattgcttttgaccaaccccaacacataatgctgtatgtcatgstgtactacttttaatttcacagatgaacacatttctgttcttttaatccacctctccaaggctcgtgttaactccatctggacaaagccttgaggtatac

SEQ ID NO: 33897 - DNA, 201 bp, Homo sapiens
caaaatagaactttatatttccagatggactgcctggaacccggggagtggctcagctaccaggctccagtggcccttgtcttgttatttcctccattagwgacctggcgtataattgtgggagggagaagccagtggagcagtcaggggactccctggctgtttctgtgtctggtcttatgggtctgggcactgaattca

SEQ ID NO: 33898 - DNA, 201 bp, Homo sapiens
cctctcattcccttcccgtataaggtggggttgcggaaatctctgccacgtccgcctttatgaaggagtgaaatcctaagaaagataaaggcccttattasaaaaccacagaccggagcttgtgttgatggaatctcgtaatgagtaattaagccgctttgcagaagtccgggctgtcatcctggcgtttgggtacttatg

SEQ ID NO: 33899 - DNA, 201 bp, Homo sapiens
aactagggaaaaatttgcatgtgtagaattttggttttttcttcggcgtgtttatttaatttaacattacctatcctacgattatttcaaggtgattttaytactagtcagctttcttttccctagcacaaaactcatgcaacatttatgttgaatgtttaaaattcttttctaaatggtttcacctttctgaaaaaatct

SEQ ID NO: 33900 - DNA, 201 bp, Homo sapiens
ttattttgtcttttacgaagcgttttcttttaccatctctcaggatcctatgtaggtatcctgatggtaagaatgataataccatgactgattattccatwgttgcaggaaccccacatggcatttcaaatcacaatcagaactttgaccttgaaaggggacccggatcagctccattctcccaaggagactttagctact

SEQ ID NO: 33901 - DNA, 201 bp, Homo sapiens
gtcttctgtcactctgtcacagtgcattatgtcagaatagaggaagcagttcagcccgtaaatctgtgccaccggcacgcagggtgttgtgttgtctccartgtgccttgtcaacaccacagggctaatagcagtgtcagggtccccgtgccatgaatcacttcacatctctggctagtacagatctctccctgtcactag

SEQ ID NO: 33902 - DNA, 201 bp, Homo sapiens
ggacaagtcaaagcatggcagccttcagcttcccaaagaagagttgtggagaaggaaaagtgaaggaaagtaccttactaagtcattgatggcacattcarcccttgtcaaagtcaaagaagaaatttggagaaattctcaccactgtgcttaggagtcaccctgaactatttcttggatgaaattaccaccctcccactt

SEQ ID NO: 33903 - DNA, 201 bp, Homo sapiens
agctggctgggaagtagcaaaagtatcttccaagctcagcttctctctgcttgcattctttccaaatacgtgattccaaagcccatgcccaatccttgcastgaagcttttagcaggaaaggtgaacagaggcatctggatgcatcgcggccagtctgccccttgcccaattccctcccctctcctgcctacaggtcatcc

SEQ ID NO: 33904 - DNA, 201 bp, Homo sapiens
gatttttattttatttttacactttcattgccctttgctctttctggctttcacctaaacaatagcatgtatatacaacagtacctataaaattgacgctygtgtcactgatcatgccaagaaacctaatgtatggtgaatttgcactagtatttatttcctccctccctgtctctcccctctcctcccctcccttccttt

SEQ ID NO: 33905 - DNA, 201 bp, Homo sapiens
catggcctccagtgatcctcccgcctcagcctcctgagtcactggaatttcaggcatgagccactgtgcctggcctctgtcaacttccttatctagaactrtctttttcctctattgttttgtccctcacttctgaatagttcagggatccctctggctactgtgttgagaataaagtgtcaaagccaacagtggaagcgt

SEQ ID NO: 33906 - DNA, 201 bp, Homo sapiens
tgagctggcagagaccaagatctttttctgggaagggatggtcctatttaaggaaggccctggattttgtcaagtttgaaaggttttcaacatcttcccgrgatggtggtcatgggagtagtggttagggtggttatgacgcatgggacgggagaataccatgcccacccggtgatttataccaaaagatgctttcctggg

SEQ ID NO: 33907 - DNA, 201 bp, Homo sapiens
ggtacctgcgagggatcaaagatggaaaggcagaaatccaaggactacgtgtgacatgaaaggggcctttctcctgctgtcatcctgaacctctgtctttyaaatttggatgtgtcgggggccacaggacactactgtgcatttgcctgtgatttgccattgggttggagtacttctcctgagtttctgcagtgttctagg

SEQ ID NO: 33908 - DNA, 201 bp, Homo sapiens
aatcctctatttaagctatcgattacctccaaaaggccctgaatgtttcagaaagaaaggatctactggcagcttctgaaggcttctgtaataccttgtaycccaatgagtacaatgaaatcattaggggttctttcctctcctttggaatgaaactgctgcttaacttttctcccactgatgagatgcggtgatgctgtc

SEQ ID NO: 33909 - DNA, 201 bp, Homo sapiens
ttctgataaaagtttatttatagacactgaaatttgaattccatatgtcatgaaattatatttttttgattttttttttcataaaaccagtctaaaaaagscatgggttattttgtcatggcacgttttgatatgaatatttccacccccattatttgcataacaaattacagattatccagaacaggtgggctgtacata

SEQ ID NO: 33910 - DNA, 201 bp, Homo sapiens
cgtatctgtgagctcaggaagcagctgcatgtgcatactggataagcaagggagactccaaccccgggctctctaagggtgtaattgttgcaggcacactraggggcagacctctgggtcttggttagtggtccagagagggaagagagcaaaggtagaaggcttgagtttaatttctgcatcagactcaaaacccagcta

SEQ ID NO: 33911 - DNA, 201 bp, Homo sapiens
tggggaagagctcatcattaacatgccttatctgacatgtggcaataacttctgcctttcttatgtcatctgcatggttgcagtggatagtcactggacarttgatgaacaactactacatgctagatctctccctggggagagtgcttgtctttgaaacagtcaaaggaggaaggaagaaaagagaggcagaacaattat

SEQ ID NO: 33912 - DNA, 201 bp, Homo sapiens
gaaggggacatttcaggccaatgtgataataaaatcaacagacaaaagaagggagagtgtggtgagtaggataaagctctgtacagatgcaaggggaaggstgttgatgtcaacacgcatgcagcttcccacacgtcgtgtggattcttttctgtgctctccattacggaatctccctgaaaataagtggtcactttgagg

SEQ ID NO: 33913 - DNA, 201 bp, Homo sapiens
aaaatagtttttcagtcactttgccttcatttgtttgacattcttggaatatttgggctctacaaggtgctagggtaaggcacgcaggatgcaagattagygagatattgtctctactctcaagaaactcgctttctttgggaatcatcacctgtttttgtgtcacggaccccttgggcatttggtgccctttgcagaata

SEQ ID NO: 33914 - DNA, 201 bp, Homo sapiens
atgttagtgaaaaataaagatgtaacattttggccatctgtgtacaccccctctttctagggttccagccacagaccctcagattaaggagtctgcactascttgtagcttgttcaatcacacatacacacaaaaagtgccagttataaaggagcaggaggttttctggagccaggatgagctgggaccaacaccagcaac

SEQ ID NO: 33915 - DNA, 201 bp, Homo sapiens
ggccatctgtgtacaccccctctttctagggttccagccacagaccctcagattaaggagtctgcactagcttgtagcttgttcaatcacacatacacacraaaagtgccagttataaaggagcaggaggttttctggagccaggatgagctgggaccaacaccagcaactgtatcacccagttcactgagagttaaaatc

SEQ ID NO: 33916 - DNA, 201 bp, Homo sapiens
gcaattggatgggaaaacagtccatcttgttggaaggctgtcaagctgtgtaataaaagaattactgttctccctttgcatttatgcattgcatgtctctkttgaattcagagtgctttatagacctctgatcagcttccagcatcctcttggtatgagttctagggggagatgaggaatgtgcctaattcccttgagtga

SEQ ID NO: 33917 - DNA, 201 bp, Homo sapiens
caaagtgttcaggttacatccaggctgattactggccaggagactaggcattcatagtggggcgtcctttaaggtctgaagaggacagtgaccatccaccrcaggcaaacatgtgtgtgttaaaaaggaatgacgttttggtctgtgctacaactgggatgaacctcaaacattacgctggacgtggtggcttacacctgt

SEQ ID NO: 33918 - DNA, 201 bp, Homo sapiens
ctgtgtcggacttgtttcagaaagacaatgtcactgaggctggggcagggagattagctgagaggctcttgcagttatctgggaaggagctgtccataaargcctgagttaagacagtagccctttgggttcgatttagtggtggctccccaaaagatatgttcactggaacctagacatttgagaaaaagggtctttgca

SEQ ID NO: 33919 - DNA, 201 bp, Homo sapiens
ttgatatagatgtctcttgatatagaagcatttctcgggatggtttttgtggttgcctagtgtcttctaaagacccctgaacatagcatagaaacagcacrtgtcttaggcttggaatgagataatgtctcagtgtttgagtagaattagggagtttgctttattttcctttgtttttcttttttgttgttgtttgtttgt

SEQ ID NO: 33920 - DNA, 201 bp, Homo sapiens
ttctttacattatctggataattacatttggtttgcttacatagatggaggcgaatggttttccaatcttcaaaccaacctatatcacaaaagcattctgmaaactgggaagagatcacttcacagtttcctgaaccactagaaaaaaaaatgttcataaatttatagccgctgacattgaagttggagaaaagagcatat

SEQ ID NO: 33921 - DNA, 201 bp, Homo sapiens
gtctacacagctcctgcctccttcttttcttcaggattatctcgagttggtttgcaaagtgaaacgcattagacatcttcaagtgggctgaagaaagggaytcaatttttgtgggtccatgttaatgtaattcttatgaatttgagataaagtggtcattaaagcctagaaggaagggaaaagctacacccccctgtggat

SEQ ID NO: 33922 - DNA, 201 bp, Homo sapiens
atgacatgtgaggcctttgacaaaccctcctatggtgcagcttcctccgagcagctcctaaggaagtgccagagtcagggctttcctctgcctgaattatyggagctcttggcttaatgtgggagaagagatgaatgatctgtccttctatgaaaggcttaccaactccattcaattcacagtggctctctgaagctctgt

SEQ ID NO: 33923 - DNA, 201 bp, Homo sapiens
gattgaacgagtgctgggattgattagtgatgtctgcagtgagcgaaggattgggaagagtaaacaggcatgctgcatatctgtcatcatggctctgagtktatcctgtttcagaagagatgaactgtgctgtagagatgttagcatcaggtattttagacacatgaagagaggatcagattcagtggaagtgccaaaggg

SEQ ID NO: 33924 - DNA, 201 bp, Homo sapiens
agaatggatattcctagggtcagttgattgagggtgtgttgggggaatgtgattatcgatgatgctgtatgctgggtactagactgggggttcgttacatsaagttgtggggtctgtggaaaggaagttgtcataggagtctaggactcagcagctgtcaccttcccaaagtcacactgctgatgagtgacagagaccaca

SEQ ID NO: 33925 - DNA, 201 bp, Homo sapiens
ctcacttttctcaggaaaatcatgactgtaaaacagatcagttttgctttagttcccaccctcatcatcaacccctccccagctaccctgcaaaagagtcrcagatcattgggataactagaaccacagagatccccctagacttgtcagccagggaacctgacactcttagaccttcttctgagtgctttgtccttgtcc

SEQ ID NO: 33926 - DNA, 201 bp, Homo sapiens
gttactagcagacaagtgcatcagacaagtgcatttcaccgttctgagcttcagtctcttatccaagcagaaacatggccagaatgcaatgtcctaatacrtgtaattcattacgtgtgttgtcatgtaatgtaacacacctattggcagtctctgacacaatacagatattgaccccatggtcttgccccaacttaaata

SEQ ID NO: 33927 - DNA, 201 bp, Homo sapiens
gtcctgtcctgggcagacataagccctgtgggttccagtttctcattaggaacctggatgatggagcagggatcatgctcattaagtccgcagaactcatmagctgcttagcagggggccaaggagggctgagcctatgacgggtgaataagtctggttggcctctgggagtacgggatcagaattccaagtgactggggt

SEQ ID NO: 33928 - DNA, 201 bp, Homo sapiens
cctggagctgggtttcttgcctgatcaatgtatatcattttgccaagagacagagtctgtgctggagagattgattccctggttatttatcttcctctgcscagtgtaaattggtcagcctgatcctattcgcatgataaaaatcataatgtctcaaattacttactcaataaaatgtgggtttgtctattattagtgatt

SEQ ID NO: 33929 - DNA, 201 bp, Homo sapiens
tggattttaagtgatgcgtcagaatttcatgatgagcaaatgcctatggatgccctcatttctcatccttcttgactgtctgctaagattcactcttggtsttgtctttgagcttttctgttcagtgatgtaatgggacaggctctcctgtcatcaagagttcccatcatacctgggcactgccatttcctctgtggtaga

SEQ ID NO: 33930 - DNA, 201 bp, Homo sapiens
tttcttttctatattgtagggataataatcctcccttgcaggactgtgctcagcacatgttcattgctcaagagaagtagccactgttattattattgtcmgtatgtatccaagtgtttagttcattttctctgcatttgtctaactcccttttttcccttgaactgtaaagctctcagcccagggatatagtagcaccag

SEQ ID NO: 33931 - DNA, 201 bp, Homo sapiens
cagtttgttttgggtgatgcagatggaaggtaacgtcacagggcagctgtattccaggtacttggtgactcttggttgcgatctgatgactggctcacagwaggaccatgacgtgagcagatttgtagtcctgcatgaatgaaggaaagaaagaaatctgacaactcattgattcagattcacagactctgcattttgaac

SEQ ID NO: 33932 - DNA, 201 bp, Homo sapiens
cacccatttgcagcacagctgggacactccacagagaatgatcaggaaggccaagcccagatggcattgttgaggggctttctcttaagactgcatctgastggcagggcgcagtagctgacccttgtaatcccagcactttgggaggccgaggtgggtggatcacgaggtcaggagttcaagaccagcctggccatgatg

SEQ ID NO: 33933 - DNA, 201 bp, Homo sapiens
tggccgacagagtgagactctgtctcaaaaaaaaaaaaaaaaaaagttacttctgagttaaaatatgaagagtgagcagtacccagccatgcagaaggacrtggagtggtaaaagcatgtggttccattaagggaaagactccagggcaagaaaaaaacatgtcatgcttgtacctgagggaaggccagtgtgattgcaga

SEQ ID NO: 33934 - DNA, 201 bp, Homo sapiens
gaaagactccagggcaagaaaaaaacatgtcatgcttgtacctgagggaaggccagtgtgattgcagagtatggggcaccctggaggtctggaatgggagsagtttaaacaggtcattagagcttcaagatgaagcataggccagtgacttggttgctgctgctgcgtaaccgtgtggcaactgagtggctcacggcaatc

SEQ ID NO: 33935 - DNA, 201 bp, Homo sapiens
cattaacgcttatagcaggattattcccaaggaagctgtagccattatatttgctgccatcacaacagtaaaataaacaggtgtgactgcagccctactcytcgggttgtttcatgctgatcagttgttaatatatgtgtgacttgaagttggagcctgttgggagaaaaagttgtctttagaggagtaaagtgttgcctt

SEQ ID NO: 33936 - DNA, 201 bp, Homo sapiens
tgccggccacactgtgagtgctgactgtcatgcattttatagcccatgtccctctccagtgaggcttttggccactggccgttaattggtaaggttcttgraaactgaagtgatggtatcagcatggatgcccgtgctttctgatgccactgaagatggatagaagcttcaagttatgctttgtgcagactgaatttttcc

SEQ ID NO: 33937 - DNA, 201 bp, Homo sapiens
gtcctccagcaaaatggtctcctggctgtctttggaaatgacgtatcagtccagatgccctttttcttgatggattgctaggatttttactcaccaccgakggaaaattctcatagtctggaagggtggagcgtctgccttctatcatgattgtacacagatgagcaaagctccttggcaatgagtgaggcagacgggcag

SEQ ID NO: 33938 - DNA, 201 bp, Homo sapiens
ggcagtgtgggggaatggagagacctgggattttggggacaacagtgaccatgaggggatctctacactcctacttggaaatggagtagcattctacactkaagtatctccctttataagctaggaatactaagaacctaagagtctccatgaggattagatgaggtaatgtttgtaaagaatctgagatatagtaagttg

SEQ ID NO: 33939 - DNA, 201 bp, Homo sapiens
cgtgagaaattctgtaagcacaggagtgtggtttatgtcaaaatcaatctgatggagtgaagccattccttgccaagcgaaaatacagcatcatcaactayatccttgagcctagaacctcttcactcagcaccagctagtgggtaaagcccgggagaggttgtaacaaatctgattccctgacactcacctgaaacaaga

SEQ ID NO: 33940 - DNA, 201 bp, Homo sapiens
ctgcttttttttttctcaccttttgctatatgctgatcccagtgcatgaaatttttttgtaatctcattcctgtgttgaagctctttcactgctttcgtgrgcacagatgaatttgaaggctgccaggcagtagcaacatataccagcttccccactgggtgttcattctacccaatttttgttcatgtggacttcaggaa

SEQ ID NO: 33941 - DNA, 201 bp, Homo sapiens
aagctaggataactgaggtaaaatttgtacagctaagctgaatggtgaaaggcccagatttagttctcattgtaggaaaaagggccagaataccttgcccrtttttgccttgggaagtgagctcaatgaaatacatcttcatatgcccattttacagaagcagcaactgagggctgttgtactgaggcttgcaatggccac

SEQ ID NO: 33942 - DNA, 201 bp, Homo sapiens
ggcacattataaagaattatgtcaacctgatttcttgaatcccaggacaattcatatccccgtgccatccgattagtgaatcaagagaaactgattgatayacagcaacaatagttaagaaacaggcagcatcgatggaggtttgattaaaccgataccctgggtctcctgctgtatcaaatcatgggcgaattggtacca

SEQ ID NO: 33943 - DNA, 201 bp, Homo sapiens
ctggactctgttccctaaaggggatgaggaatgaaaatgaaggtttgcaaagacatcttgccagacccttacatattttaatttaaggtggtattactgtyctcattttcaagctgaagaaccaagctctgagagagttaatgattttctccagatcattcacattcatttctgttacacagctgggattataatccatgc

SEQ ID NO: 33944 - DNA, 201 bp, Homo sapiens
attttagaatcttccaaacctccgtaattgtcttgttgatttcaaacaccctgagaacatttcctaaatgctcatagcgtccaatagcatgggaaagtaartggtttatgaggagaatttgggatgtgcaaaataagcctttgaagagagtgcattatctgaagcctgacattgtaacagcttcttaattacgctttcttt

SEQ ID NO: 33945 - DNA, 201 bp, Homo sapiens
tttctttatgtgtgttaaaatctccctctacccctttcctttagcacctaattcctcttctgaaccgatgttatttcctggtgcatccttctagacattaytatgcatttacaaggcaatatgtttgtatattcttctgccctccccttcactttgctatacacaccttgctctttttgcttgacaatatatcttagagat

SEQ ID NO: 33946 - DNA, 201 bp, Homo sapiens
aagcagtaaggcctgactggtgtcacgatcccacaacccgcacaaaggtgccattgttgcccagtgtgaagggagctgaggcatcaccaaagggggccaarcgtcccttctctgggttagaaatgttgttttccatttgctggtaaacaacagtccaagttcattgtcctgacacagaactctgtttcttcttttatgctg

SEQ ID NO: 33947 - DNA, 201 bp, Homo sapiens
ttgaagttttgacgctaatgtgatgataattctcttttctttgactggggacttgcctttgtttatctttttttgttgttttagccatgaaatatcacatrtaaatagccgaggatatctgggctctgagtctttaaaaggcaacagaaaggtctctgttacgaagggggaactagttttcattgtcactgtattaagcag

SEQ ID NO: 33948 - DNA, 201 bp, Homo sapiens
ggaaattcggactgtggattacactgagtaacaatcctaataatacctgcacacaatcagttgcctgtccaaaaagcaataaagaacctctagattttgtkgtcaccatattaatcataaattggggatcatagaaggccttaatctcattgtacatacttttctattcctcccagtaccatttaaaggttagtgaaagca

SEQ ID NO: 33949 - DNA, 201 bp, Homo sapiens
taaacttgatccaaggtttaggctctcagtgcctgtttcctgtttaatacatatcatggttttggaaaaaatgaaagaaagaaagaagaggaagagctgtmattcctctgacaagtattttcagtggaattagggtcatgatgtcatgcttatttcaaaagatagcttcatctgtgccttcacccagacttagggttctag

SEQ ID NO: 33950 - DNA, 201 bp, Homo sapiens
agaggactaatacatataagaaggagaaagggagggaggaggaattccagttgttttttttttaatctaggtacaagtctctctgttgatttctaaacatygaatgaagatgaaggaaatacttaaagcacctaagcactcataactcacttagtcatttcactattaaaagagaaaaatagttagtttacaatttccagg

SEQ ID NO: 33951 - DNA, 201 bp, Homo sapiens
agaaagtattaggaaaaacagagtaattctgtagaaatattcctgatgatacactaggcaaagcagggagaagagaaaaagtgagcaagaaattgtgactrtgaattccaaaccagtttggctggatgagccaaaaagacaaaacaagagcattcaagagtctgtcaggaagtggtggcctttagttcattttagtagcaa

SEQ ID NO: 33952 - DNA, 201 bp, Homo sapiens
tatggcaacactgctgatataggagatcacttttccgcacaaacacctctaggtattgtttaacacagacctcatgaaataggtttgccatggattagatraggcaattctggactcacttccaggatagaaggcaaagacaagtaccaatatatttggtaaaaatatgacatgacatttgagtgcacacaggcaagtgaa

SEQ ID NO: 33953 - DNA, 201 bp, Homo sapiens
tcgcatgtggtggtcagatccttttcactagagggtcagcaaactcagtgacagaggcaaggagacaagggattcagggccctttgtcatttatgtagcascagccctgaaatcggagactcataaaacctacaaatacacacacaaacacaaaccaggcaaacccacacaccacagagaagaggcaaagtgtgcataaag

SEQ ID NO: 33954 - DNA, 201 bp, Homo sapiens
tgatctcctttaaaaaggctgcgtcccagcagcatagaccagctttacctcccagcgtagtcttcagacaagttggggtattgccgaagtccattcttgastttttttaatagtgcaaacaaatcatcttgtttttaggaaaacatgaaattataaagaaattgacttcaatcacttctggaggcagagcactgagttgcc

SEQ ID NO: 33955 - DNA, 201 bp, Homo sapiens
atctttggattaaaaatggtaccactctcataaatcaatgagtttcataccctaaattatgccagattaagaaaatgaaatctgactgtaaattacttctstaggagcaaatgattgcttgattctattgtagaaaataaaaattttttacttaaaccacacaaattaaaaaatggaactcactttcacagtcaagagtta

SEQ ID NO: 33956 - DNA, 201 bp, Homo sapiens
aattaccaaaacaaatatgatcacagaagcttttaaaatctgaaatcccaggaagctaattagtgcatccttttaagatggcttcctgcatttcgatatamgcataagcttgggtttcagatgcagttggcagtttgccatgagtcagacaggtcatcctgactctcaggaacacggagctcctgcagaagcctgtggagc

SEQ ID NO: 33957 - DNA, 201 bp, Homo sapiens
gtgagccgagatcgcaccattgcactccagcctgggcaacaagagtgaaactccatctcaaaaacaaaaattaagagggactgatgtccagtgaatttctrtgtccgccctaagcactgaggtgaaatgaagcctagatggttcttttagaatatgagtgagcagtactcatggttaattttagaagctaataagtatata

SEQ ID NO: 33958 - DNA, 201 bp, Homo sapiens
tgaggacgtgctctgattctgatgaaggatgttagcattagaggcaggcctgtgtgcctgttctgtgtcctggcaccgatgtttaacaaaaaagatccttkcagagttactcatacgacttacacattcccatgggagctccaactctgtttggtcccaatgtgccctttttgtctcactccttcctcccacacatcctgc

SEQ ID NO: 33959 - DNA, 201 bp, Homo sapiens
gaaataacttcatggtggcacagagagctgtttagttagaagactgagtattatatttcccattgactatgcaggaccttctagggaaatgtgagtttatsatactcctgcaaggtaaatgcagcagtgagaagaatcagtctactgtgctaaacctggccctgcctcagcaatattctgtgagcctggaggtcaagagtt

SEQ ID NO: 33960 - DNA, 201 bp, Homo sapiens
gctcagtgaatccagtagatgtttgaatgggaaaggactgaaagatctcaaccttgaatcccttaactccttgggatgtgtaatggagatgtataagctgwttttaaacatttcagcagctgtcatggaacttaaccaaatgagtctaagtaccctatgaacacatttgatttaggttggaattacagcatagatgtgaag

SEQ ID NO: 33961 - DNA, 201 bp, Homo sapiens
agacaggcgcgtctgtctttcacggcttgggttgtcaggatgcagggagggccttttgtcaaacacctgccgatgagcgtttggcagagcctgtgctaagrcatcatagatttccttctgtgttgtcttgagagcagagaaggtggcaggttaaagggaatcaggaaagaaatgagagtgaggataaacgagagggtgtgg

SEQ ID NO: 33962 - DNA, 201 bp, Homo sapiens
tctgtgttgtcttgagagcagagaaggtggcaggttaaagggaatcaggaaagaaatgagagtgaggataaacgagagggtgtggttctcagggtagaatrcatcggacactgcctagtgtgagaagggactcatctgttttctaggaagtactataaaaaagataaatttagtgctcagatatctgaggcctgatattag

SEQ ID NO: 33963 - DNA, 201 bp, Homo sapiens
ggacattggactttctgtttccagcatggtctgtcgtcttccataatggcatttaattttggaaaaattgcctgagcatttggaacaggcatctattaggraagcctatttcttttttttttctttttgttttttctgagacaggatctcactttgtcacccaggctggagtacagtgtcaccattgtggctcactgcagc

SEQ ID NO: 33964 - DNA, 201 bp, Homo sapiens
aagatgtgaggttgtacctggtaaggtctctattggtcaaggaaaggtttagcatggagagatttctcttaaggtgcctaggtattcagaagcacccctawaactgatttgtgtggccctatgcttacaagtggagcctttccctcatttttgctttatttcttttgcctctcactttttatttcctttgtggagtccagc

SEQ ID NO: 33965 - DNA, 201 bp, Homo sapiens
atctcccaatacagaacagaaagcacaggttatggaatcagatagaccaaagttcatctccaaatttgattccctctgcatacaagttgcttacccttggsggccctgtaaaatgaccataatagtaagcacctctgaggctcactggaagaactctttgttgtctgcacagaagatctcagcactaagcctggaacagag

SEQ ID NO: 33966 - DNA, 201 bp, Homo sapiens
agtgtagctccaatgtgagttgttacttgtagagaacagctatgtcaaaaccacaccaaaaacgatttggaaaggaaataatttgactggtcattttgttyatccatcaactgagttggattgatatatttttcctttggccttcaaaggaaatttgagcattcattcattcatccttttagagaaatattctctaagcac

SEQ ID NO: 33967 - DNA, 201 bp, Homo sapiens
aaaaatttggttatctcaggtggtaaagatgcctttgtttaaaatattcttctgttagtggggacaataatactactaatttctagtactgacgcttctcmtgcaatttaatcagtaggaacctgtttgcatgttcatttgaggaagtaccaaagccaaaagtagcttcgaggtttggcacctctgataaagttacagaag

SEQ ID NO: 33968 - DNA, 201 bp, Homo sapiens
ttgaaaaatgcttaaaattcacaagtctatatcattctgtcctccaggtaccccaagctggtttgggtttataccagtttgaaccgagggaccttcagctkaggaacatgtgctctgtgtgctggaagctcctggaggccccagggttatctctgctcacttaggtttgtgatgttgggcaaaaggagaaaatgctgagtc

SEQ ID NO: 33969 - DNA, 201 bp, Homo sapiens
tcccccaatgagagacttttttttttagggggagccaaattatttgttacaacatgtagatttcacttgttgtagagatgttctattttcaaggatacagrgctcaaagggagcacaattccctggagagctagggaaataatgaagtctaaggtctggcagatctggatctgaatcctggcaatgcatttcgggagttcg

SEQ ID NO: 33970 - DNA, 201 bp, Homo sapiens
gcagaattccccctaaaggatctatcatgcgtaaggtggaccctcacagaaagcgtcaaagacacacgaatctcttagcaggaggccgccaggtggcacaraatcaaaactgcatcattgagaattatgttatgaagtcatttactgacttgagcctcagttttcctattaatacaatgagactgtagtaacttcataggg

SEQ ID NO: 33971 - DNA, 201 bp, Homo sapiens
gggaatgacactcttcacctgtcatgggagaggcaactgaaaaggagcctgaggtttttctacctttgtgaacctgttgctagcaaagaaatatttttccwtgtggcaaaagatcaacatctaaacacattgtccacgtctaatttgttagggagggcatgttctcttctggagggctaagagttggcatgggatctaaat

SEQ ID NO: 33972 - DNA, 201 bp, Homo sapiens
tcacctgtcatgggagaggcaactgaaaaggagcctgaggtttttctacctttgtgaacctgttgctagcaaagaaatatttttccttgtggcaaaagatsaacatctaaacacattgtccacgtctaatttgttagggagggcatgttctcttctggagggctaagagttggcatgggatctaaatggattctccagaac

SEQ ID NO: 33973 - DNA, 201 bp, Homo sapiens
tgcaaatctggcacctggagatggcattttgaatcggacgacctttttagtaagggtcacttgctgttggatcatcgaagggggtgctgagtcttcatttytgttcatccaaatggatatcatttcaatttagctccatgagtaaatcaatggaaaaaaaaatctccttttaacatttctcgggtgaacacacgacagccc

SEQ ID NO: 33974 - DNA, 201 bp, Homo sapiens
gggtttgaagaggtatgtgtctttccttttagccaaacctgctcacttcagatcaccactttgtcctgggacgttagtcatgggaacactgccgtcttcamaagggctgttctccttccctgctcttggtgttccaagcctaatctaacttccagggttcattcctttcataactctactttttgcataagtggattaatt

SEQ ID NO: 33975 - DNA, 201 bp, Homo sapiens
tgattctcaaaaaaaaaaaatcgtttaggggaacccatagctccagccagtgtttgtatgtcaaggtattattatttatcacaatggatcagtaagcattsatgacaactggcaaggtattgcttcagatattttataacggagttgttaacattatttcctttagatggctctttcatcttttctgcattatgaactgat

SEQ ID NO: 33976 - DNA, 201 bp, Homo sapiens
aggtaggtccccagctcctgcaacaatggcattctgaatcaatgggactgcagaatttcttagcaaaaataccattccagtaatgcaagagtgcaacgtgktatcattacagtaggtcatagtggcaaaatattttatcaggttaggaagaattctgctttttgctttcccaaacggactgctttggtctttcctcacgct

SEQ ID NO: 33977 - DNA, 201 bp, Homo sapiens
ggacctgactctcccagggatcctagaatgcaagcatagtgattgcaaaccagaccatttgagggaaactcctccagtaagcaccctgcatggtcacaatrtaaaccctgcaggggcagaaaaatgataagctttgggtcgggtcggaaagccatttcccccacaatcaaagttccttagtgttttccttgtgggggcgag

SEQ ID NO: 33978 - DNA, 201 bp, Homo sapiens
ttagagacgtgccgaccatgtctccctctgaacagcagcctattatttttaattatggcttgcaaagcaaagtgatttcttgccctctttatagcatccckgacagtattctgtcagtttggatgatatgatgcctcatcactgcacacgtccctagccacagccgcaactgttactcaaaaggtgaatgaaagtgatcag

SEQ ID NO: 33979 - DNA, 201 bp, Homo sapiens
ggatgatatgatgcctcatcactgcacacgtccctagccacagccgcaactgttactcaaaaggtgaatgaaagtgatcagctgcactctttgcaacttamattttgaagtgggctgggaggaaatgtacccccttacctgtggtcccattgtaaatctgggtcaaatatgacatttagaaaaaggttttcatgggatctg

SEQ ID NO: 33980 - DNA, 201 bp, Homo sapiens
gtatgaggtgtcaaaagttacaccagctttacaagcggagtttatgaactcgtttttccaggatagtcacattatactttttacagtcatgtgctttcagsccagtaccctttgctatgccaagatccagctgaaactgaaccaggtgggggaggcctgctaatgcccaggcagtcgaaatgacgccatctcatcactcct

SEQ ID NO: 33981 - DNA, 201 bp, Homo sapiens
gatgagttttggtctgggaaccggagaatggtggtccatggacagaaatagagaaggcaagatgagaagatgcaataggcaaaggcagtgagtttaatggytgacttttggtatttgctgtgtatgccctctgtacctttgacctgggccttcaacccttggacagagcttaagatggctgcgtcccaagtggtccatccc

SEQ ID NO: 33982 - DNA, 201 bp, Homo sapiens
tccatatagaagtatattaagaacctatatgtaattactatgactactaattatttcatgggaaaatgccctcctgctgagatgttttagatgctccaaasttagaagagaaaaaatgaaaacaattaaaacaggataacatggacagtacagaagtaaaccactgtcttaaaaggccaatccatttggcataattaaaaa

SEQ ID NO: 33983 - DNA, 201 bp, Homo sapiens
acaggtggttctattaaacacatcaactctgtgtatataaagtcttaacccattgtggaataaattaagtgctcaattaaatgttagctgctgctattaayaacaacaataataatattttcttcacgcatgaaagtgcaaagtgatgcttacttttcttaacctctccaactggctgaaagaggagctctagggcagatg

SEQ ID NO: 33984 - DNA, 201 bp, Homo sapiens
aaaaaaaaaaagaaagaaagaaagcaaaggttttttcctcccaagaactcatggtccaagttttggtttttaaatatgcatctatgacagcacggatcacrtagtgcattgattgtttgcctgtaggtctccttatttagtcaacaagcatgttttgatcctttattctataccagccgtcccactggactctcagcacat

SEQ ID NO: 33985 - DNA, 201 bp, Homo sapiens
aggtgtgagcccccaggccctaccctgggcccctcctttctggcccctcaacctgttttcttccagccatgccctagggagagcttggctgtggccttgcrgaccctctcagatgccactcaacaagggccaactggagagaaatctctagtctagggcacaaaatttctgtcaacccttctaaccagtgtttgaagtacg

SEQ ID NO: 33986 - DNA, 201 bp, Homo sapiens
agcagacgcagttgctaaagctgtcaagtcccgctcccttggaatgcagtcctggttctgctacctccaactgggtcgatttcaaaaaattatggacttgkctgagcctgatgtggtgcctggccagggctcactgcagcgcctggtatacaggaagaacttgatgttattcatggcaaaagatgtctggatggtctccac

SEQ ID NO: 33987 - DNA, 201 bp, Homo sapiens
gagagcttgggccaaaagagattctatttttactggagcatgtgagggtggatcacaactaggatggcgcgaagttcacctcgtgtaagcacaccaggctkcagggataataactgcactttttaaaaccagcaaatcattcatatttactttatgaaacctcttttaactttattttttatattttttttattttcttgt

SEQ ID NO: 33988 - DNA, 201 bp, Homo sapiens
ggcagcttgaggactccgtgtgttattcacatgctttatttaatagacttgcctcatgtgactttctatatcatcctttgtgtctaagtgatttgcactgkgaagatagtaaacgctcccactttatatgcagaaggttgaaaacaccatgagtgttgcaatctgaggtatctgcccttaaagaagcaatatttactgaaa

SEQ ID NO: 33989 - DNA, 201 bp, Homo sapiens
aactgtgactacactgctgcactcaacttgggcgacagagtaataccccgtctcagaaacaaaaacaaataaacaaacaaaaagctaaataagttgcagasagcagtcgcttcactcctaaacacttaagcaggtgtgtcatccttgaattactgaattagagttcagtatttgcttatgctagttatgttagtggtatgc

SEQ ID NO: 33990 - DNA, 201 bp, Homo sapiens
ccctagggagttctcaccaaccttgcaaaatgagatggcagtcttcatcgtggatgcaattatgtttcattgttaaccatcacaagcaacgggacattatsatgactgttataagttggtttcacatgtaaactttgacctcagagcaatggggcaggcttttcccaaggaccctgttgagaggttcatgatggtgacaaa

SEQ ID NO: 33991 - DNA, 201 bp, Homo sapiens
tgaatccgtctctgttaaggttatcaactttaataaaccatgtattatttccttaaatattgtgcaatgtgcagggaattatttcagttttgttttttatktagcacaaacctaaatattacacgtagcaaatgtcacccgatgcaactgtctgtcctgaagaggaggacagattattctgtggctacctaatggtgttta

SEQ ID NO: 33992 - DNA, 201 bp, Homo sapiens
tggaacaacatacaaactgacccttaggaaccttctaccaaaaatatcctgtgaatcttcatacttttgtaataccgtttagttagaagtggtcagacttycttcgtcctcttttcgtgatttcctctgtggtgtctgtggatcgataccggcagctcaggtaaggaacgtgtgcaggggatgtaacagaaaggagaaaga

SEQ ID NO: 33993 - DNA, 201 bp, Homo sapiens
aaaagaaaaagaaagagagaaagagaaaaaactgcaaaaccgcaaactggcttgttcttatgtggttgatggggacagcaagattacatatatagccagcrtttgattctcaggactggtaaagtgtgaagaacagcagtgacattctagtcttcaataaatcactataaaaatgtttatgaaccctgcaatttactgtct

SEQ ID NO: 33994 - DNA, 201 bp, Homo sapiens
tttgtaacctgtaaccccctctaccccaaaagtatattcaagagcgaaacttttggtatgacgatgtcttacatcagtagttctgaatgacttgacttagstatctttcttgagtctctcaaaagacagatggatggatagattgattttgttgtaacacctgttcagttttgctggccttactcgttttcaaatactcaa

SEQ ID NO: 33995 - DNA, 201 bp, Homo sapiens
atattccagataacggttatcagtttttgattctacacatacttcaaatactattaatgcaaaatccttctttagaaatgttacctaattccaatgtttcrctttattcagcgaagacattcctttgattattctggttaggtgttatgatgccaatttgcccacacattttttcttaggcgcctatgcttgcagtagaca

SEQ ID NO: 33996 - DNA, 201 bp, Homo sapiens
ttctagtagtagggcttagaggttcctagagtaggaaaagcctagccaagcagaaacccatgtttttgactttcaggatatttgtgaattaatttacttgmatatattggccaagatctagcataatctcttaatattcaatgaataaaaaattgagttttgagagcaaatattttggtaggaaatagagaactgacacta

SEQ ID NO: 33997 - DNA, 201 bp, Homo sapiens
agatcacacaggcaggctgaggagcgcttaacaccccagcctcccatgaagcatcctgaaaaagcagactttgtcttcctccatcagctttgtttgtcctstgccgagactccagggacatgattgctcttcattttacgctcgagatcaaaataaacagaaaccactttcagctttcccgttccagggttaagtgcccaa

SEQ ID NO: 33998 - DNA, 201 bp, Homo sapiens
ctgtcagctccctgactacaaggactttgttgctcacaatcatatccacggcatccacacaagatctggccgctacgtggaaggacacatagttccgtctsgcttggagcctagcttgggagagggacagtagtggggaagggtgagcttggagatagagctgaccttcccaggtgcttcagcagttacagcaagattcta

SEQ ID NO: 33999 - DNA, 201 bp, Homo sapiens
ttgcagaaagcctagctccccagcttctcctgaatctacgtttttctattttgtctgaactagccaaggtctctggagtttgctgttatattgcttcagaraaattagtgacattgaaaggctgttgtcttttttagtgtacttttggttgttaggagaaatttacaaggccatttttttctcccgtctctgcagttcagg

SEQ ID NO: 34000 - DNA, 201 bp, Homo sapiens
ttctactgtgatctcagcagtgatggggctggctttgagggttggagatcacacacacacaatcagccagctctccaaagcaagccccacactctcttgaygctatcctcaataaacatgcggtctaaacagtaaccatgttctagctatgcagatgcagtttaaagacaaatcctttgagcctccagcatgcgatcccct

SEQ ID NO: 34001 - DNA, 201 bp, Homo sapiens
gagtcacgggctgaattccggcactgccacatcttgccacgcacatcctaagggagtgtagagaagagagttttcagttatgcatgacactgccttacccrttgtggattcagtagggatattcataactgtgaatttgaatataactattaaataattgaattattattattgagttactgaatataactattgagtttt

SEQ ID NO: 34002 - DNA, 201 bp, Homo sapiens
accccagaaccggaagacaaaaaacttccttcacacactcccttgctaagaggagaagccccaaagaagctggatatggcccttccctcacatttgctgtyccaagtgtcccatggcagtgcctaagcaattggtgggatggatttgtgtctataaacaaagttgcaagggagtctggaaagggagttttaactccaactt

SEQ ID NO: 34003 - DNA, 201 bp, Homo sapiens
aaatagctacccttactatttagaatgctattatttagaacataagtatatttaagaaagcaccatcagtattcaatttgccttgctaataaaaagggatsaagatatggattgtaaagtagaaaaatacatgtcaattaaatggatttacatcttaaaaagtggtgaggtagacacacaggcactactcacttcattcct

SEQ ID NO: 34004 - DNA, 201 bp, Homo sapiens
ttgccaaatgcatttttattggtagaacgtaagcaaatttaaaaaagcaacaaaagcagtttttatgaatacctagcgtactttttttttttaatgaaccrtgagctgtttttgcattcaaattctcgtaggcattatattgcatctacacataaggacacagtgtttacagaccccaaagcttgctgtcccctgggcagg

SEQ ID NO: 34005 - DNA, 201 bp, Homo sapiens
tttagaagtgtctggttcctgaaatacctcaattccttttgcctgcctggctcctctcctctcttctgcctgttcattgaactgaaagattatcaggactrtattcagcccggccaataatatcacaaaacaaaaatatcttgtgggtttgaaatttatgagtgttttgactgttcacagcaatgcctttgagaatcacag

SEQ ID NO: 34006 - DNA, 201 bp, Homo sapiens
aggtaacatgcattgaacacttatttgctccatgcaatgttcacaggtctttacatgtaaaaacaaccctgtaaaataaataacattattctcttcattcyccaagtaagctgaggcagaggattccagcacaagcaatttggttccaaaacctgcccttttaacctctaccagattttggtgaactctctgtctttggaa

SEQ ID NO: 34007 - DNA, 201 bp, Homo sapiens
tattttctctgcaaacctgatgaaacactccagagcccgcacctacatgcgtgggaactgataagatgggggttgtgtccacttcacttgtatgggatgtyggtgctttgaaaaaattctatcatcaaagagtaggtttcttagttctgcaaatctggcacctggagatggcattttgaatcggacgacctttttagtaag

SEQ ID NO: 34008 - DNA, 201 bp, Homo sapiens
ccagtctgatccttgaccttcaggtgcatctctaaattctttcatgtcagggtctctgaaatctgaacacatctcaaagttcccttatgcctggcaggggyggtgtccgactttgttattgcctatgcatgtataaatgtcccaaatgccagcaaccaaacttgcaggatgggtgttgacagattccaggaaagtcccaga

SEQ ID NO: 34009 - DNA, 201 bp, Homo sapiens
ttacattttgtctctgtgcccttttacagccttttctcggaggagctgagtcccattatattccgaaagcatatgttcccgatgattgctcattctctttscaataatatctttgcaggacaaagaggaatggggaagggaacatacttttaggatgtcagtcccagttttaattacaagtgttcctggttgtggcattca

SEQ ID NO: 34010 - DNA, 201 bp, Homo sapiens
ctactttttgccctgactcccaccagataatgcccatcagatggcacctcttttggctgaaaaatcgaaaactcatcactcttcctgcattcattagacartaccctttatgttcaactttgtaatttaagtcccattcttgcctcatagaattattgcccgttgacctccatataagtatctgcatttgctgcatcattc

SEQ ID NO: 34011 - DNA, 201 bp, Homo sapiens
tggggtcagtagcaggccaccaagagccatcccacctcagaaagacagaagccatcactgcaaatggcaagggcatgaggcagtttgaaactggcaaaackggacctttcatggaatccagggcttgagctttaatgctttacacttttgttttttcattccatacgcttttgctttagcttcctggcaaaattcagacaa

SEQ ID NO: 34012 - DNA, 201 bp, Homo sapiens
cctgattcatagatgtctgcccttcttgtgcatcttcacatggtgggaagagggtgagagagctcaccggggagtgtttctcccagttcctccccagtacrcagaaaaacaaagctttctgtctcaccaggaggactccacggtgagcatagcttggctcagcccagcaggagattttgaaccgactctggtagattcttc

SEQ ID NO: 34013 - DNA, 201 bp, Homo sapiens
tgagagagaaaaaaataattcctagatctagagttggtgtgaggctaaaataagctgcttttagtatcacatttggcaagtagtaaactctggataaatakacttttgaattgtgtgattattgttgttaccatttattgaaagggaatgatgaatgtagtgagagaaggaaggaagagagagagggaagaaggggaaaaa

SEQ ID NO: 34014 - DNA, 201 bp, Homo sapiens
aactgaagtgatggtatcagcatggatgcccgtgctttctgatgccactgaagatggatagaagcttcaagttatgctttgtgcagactgaatttttccartttgtgcttagtagcatcttattatattagaccagcactgactggtgatgaatagcaagattgctcccttctaagggcttggcaaaccaagaagaatgca

SEQ ID NO: 34015 - DNA, 201 bp, Homo sapiens
taatcgcagcctccagcttctccttcacacctgtctcctgtctcctgctttttctttttgtgcactgcccaagaaccttttcatctactaatctttgagtytgccgtcctctcttcctaaatcactcccctccctccactgttccacgtgggacgttccttccagagaggcctcccttaagcccaccttccatacctcctc

SEQ ID NO: 34016 - DNA, 201 bp, Homo sapiens
gataaagtctgtggctccagtatttttctaggtcttgctccctccctgaccttttcacagtttggtgacacaactcttccttgaattccataggttgacamattcccctgagtttgggttagggttttgttacttgcaaggcaggcatcacagggctgctcctggccatgcatagctttggaatcacttctctgattctca

SEQ ID NO: 34017 - DNA, 201 bp, Homo sapiens; identical to SEQ ID NO: 14937

SEQ ID NO: 34018 - DNA, 201 bp, Homo sapiens
gagacagaaacacagaaataattctgcagtgctttaaagaatctgttaaaaatcaagtttctttcagtcatgtatgatccattgggctttatataactttyagcctttgctttgcagggacagcaaagatgtgagcaaatttgtgcaaacctaatagggtgaaaaattgaggtatgaattagtaaagtcatttgtccttct

SEQ ID NO: 34019 - DNA, 201 bp, Homo sapiens
agactgagagaagtttctaagctgatgctgctctactacctggagtaggaatgagaaaccatctataaatattacctttggtgtttccatcaaaaatttasaatttcaccctattctatttttaattctggtttaagactgaaggggttcttggtgaatacttttgtagatacaattaatagttatgaaaatcattactga

SEQ ID NO: 34020 - DNA, 201 bp, Homo sapiens; identical to SEQ ID NO: 8819

SEQ ID NO: 34021 - DNA, 201 bp, Homo sapiens; identical to SEQ ID NO: 8820

SEQ ID NO: 34022 - DNA, 201 bp, Homo sapiens
cataaaccctaggccatcccgaggctgtctcactcaggcccctcagccctcataaccccccagctccataggagtggagtttggatttcaactagataagscccattttcatggatggacatgtgagttttcatctataatatagaatgctattttctagttaggttggagcaaaagtaatcgcggttttcaccattatat

SEQ ID NO: 34023 - DNA, 201 bp, Homo sapiens
cgttgcagaacactgaccaatgttggcaactacaagacaatcaggcgtgattcttcatccaggatctgcttttccctgtcctgccaattcttgagctgctrataaacattctgatgcaaacatggaatacagatttcagagggattctgggtagccctcggagatgaggatgctttgcgaatgtaacaggcatctctcacc

SEQ ID NO: 34024 - DNA, 201 bp, Homo sapiens
ggtagaggaggaaacacagtcttactgtgccgtgtgctgagcgcagagccattctcagcatcctgccttgattaataaggcgtgaaagatcctccgaattmgcacctgttcagacaagcttgtccaacccatggcccccgggtcgcatgtggcccaggacagctttgaatgtggccccatacgtatttgtaaactttctta

SEQ ID NO: 34025 - DNA, 201 bp, Homo sapiens
ttttcactattagtttgcttgacaaaggatagatacattttccatgtgtggaggtaaaagcagtgcagtgagctaaaaagttagcaaaggtgaagtggtcstaatctgcggccctggtacacttagataggcatcattgcctttcctctgagctcttggtgctgataacagcttccttgaccgataagtgtaccagatttc

SEQ ID NO: 34026 - DNA, 201 bp, Homo sapiens
ttttctcttctctccccttccctgctccctctctttaaggttttctcacagattaagagagtagcatgtgctcatcccaattattgaaaccgtgcaaatgratagcaagaaaaatagttcttggcgtgcccctttctttccgcagtgcccaggccagaagtacctgctgcccaagaccacagctgacagcgccccgggagt

SEQ ID NO: 34027 - DNA, 201 bp, Homo sapiens
atctagccctcagctgtgtcactgggcagttgtttcttccactgtgcagtgtttcgttcttaaccaacatggcaccccaggttcagtggtgagagtgtcastggcaacttctgaaataacatctctgttagtttgtggagtgggctaaatggccagcccttctacgagctccctcatggttgcgggggactaccaatcact

SEQ ID NO: 34028 - DNA, 201 bp, Homo sapiens
acctgatacacacaaagctttcaggcaaggttagtttcgggtatttccagccttagtcttggctgtgggagccataatggagttgttcagaagtttacagstagtgtttataaattgcttgccatggggccttgtatacagtaagcattcattaagtgttccctcctattatatccttaggtttaagatacaggcaccaca

SEQ ID NO: 34029 - DNA, 201 bp, Homo sapiens
aagagacaggcacttgtaaatgttgagatgccaagggggaaagaattttagaatccagatccgctttggtaagagtggccttcgagcctcatgtattctcygttcagctgttaagattgttattaaactttatggaccataaaccccacagaaacaaggaggttgaacaaccatgctattacacaagtgtcaaaacaggag

SEQ ID NO: 34030 - DNA, 201 bp, Homo sapiens
ttggtgtatgatgacagtttaaaaattcggatgcattttgcacagaattaagacgttatgtgcaatccttgtgtttctaattatatgttgatcaatgacamctttacaaaactgtcatcagtctattggtggttgattggtccaaccttagcccgatacctctatctccgcttagtcattcctggtgggtgactgatgacc

SEQ ID NO: 34031 - DNA, 201 bp, Homo sapiens
gtgctactattatccctgctgctgttaaccccaactagataagccaagataaggtgctctccattgtttacctgaacaggcagaaaagctctatgcagctrtccagacccaagaggatccgacagctctggaacttgtaatatttgcagcatgtcttgccctcttaatgtctaagaagtcaaaaaaggacacgtatgccta

SEQ ID NO: 34032 - DNA, 201 bp, Homo sapiens
gcagtaaagagcaggtccattaattcaggggggatttacatcagttccatctgcctctttcctaatgggactgtttggttgtgttctttcctggagagatkagtgattgaaaggaggagatctagaaagaagagataaaagtttacatttaattttcatgccatgcagcgttctacgaaggcttcctaaggaggctccata

SEQ ID NO: 34033 - DNA, 201 bp, Homo sapiens
aaaaagcaacaaaagcagtttttatgaatacctagcgtactttttttttttaatgaaccatgagctgtttttgcattcaaattctcgtaggcattatattkcatctacacataaggacacagtgtttacagaccccaaagcttgctgtcccctgggcaggtgcatgagggggtcccaggcaatcaggctcttctcaaacct

SEQ ID NO: 34034 - DNA, 201 bp, Homo sapiens
ccatttggtgaagctgaggctggtgcagttactctgtggagacaccagcgtcttggacctagggatggattcagggaggattgtgtcccccagtgacctgstttgtgaaaggtagagaatagattacaggtgcccgagatcctagaacccgtttcttaccatgatggcgttgaggtagaggtagaaagatgggtgaggtgg

SEQ ID NO: 34035 - DNA, 201 bp, Homo sapiens
tgtgtggtgctaaatgcaaaggcagagaagcttctgctattgaatgcttagcacagaactcctgtcctccctctttgaaattattccgacagttgcccctyatttggcttgccaaggagtaagatcttggcttgtgtgtttctcccatgtgtggtgtatctgtaatctcggtcactgttgagagcctggtgggaggctgat

SEQ ID NO: 34036 - DNA, 201 bp, Homo sapiens
gcatgtgagggtggatcacaactaggatggcgcgaagttcacctcgtgtaagcacaccaggctgcagggataataactgcactttttaaaaccagcaaatsattcatatttactttatgaaacctcttttaactttattttttatattttttttattttcttgtttctttttatttttaaaatttatttttgttttttttg

SEQ ID NO: 34037 - DNA, 201 bp, Homo sapiens
cataccgtcccctgatagtcggtgggaactgggtcaggttccatttgccaggggcaggacatactgcgtgccttggccttttctgggctactcaaaaaagrattccaccaggtaaacttgaatcacctagcgctggtagaaagccttgctcttcgtcatctctcctgtgtgtcgctagccttattaaaatgtgcagaggag

SEQ ID NO: 34038 - DNA, 201 bp, Homo sapiens
aaacaagtttgagctaattgggatcaggcagtactttgcatgtgagttctgaacagggagcttggctgcaaaacgattattgtatttaacttctgttggcrtcattcgcatacttgtatgggagatccagaattggaatttaacacagttttcccaggcccttcatggaatttgaaaacatgactctgaaagcatgtggct

SEQ ID NO: 34039 - DNA, 201 bp, Homo sapiens
ccaccccaagtcacacagttagctttatagttaaatcagggtgtgcctgatttcctagccataccaggcagcctatttcttgaataacctcccatcccctstgtctcctttgtggagctcttggcaatactctggtgattggtaaccactgatacgccgccagcagtccacgcttgggtggaaggcaggtttcacgtaact

SEQ ID NO: 34040 - DNA, 201 bp, Homo sapiens
tctcaggatcctatgtaggtatcctgatggtaagaatgataataccatgactgattattccatagttgcaggaaccccacatggcatttcaaatcacaatsagaactttgaccttgaaaggggacccggatcagctccattctcccaaggagactttagctactacctttcttactttttgaataagtattttgcagggct

SEQ ID NO: 34041 - DNA, 201 bp, Homo sapiens
aaggaaagcactgttatcagatgaagaagtagatttcatcaagtgactcacccggtatcatatagctgcttagcggcaaaaccaggatgtgaatggagagstctttctcggataccaaagctatttaatatttatcattgactaataatggtagagaaagtaatcatcataacctctgccctttattagtcactcatggtg

SEQ ID NO: 34042 - DNA, 201 bp, Homo sapiens
tttaagtttcctcactccttttaggtgaacaacccaaaccctcatatgccctagaggcccttttcagccctgttgacacttcccttctctgtgctttagtyaccctaccctcggtcaactcctaactcctgcctgccacagggcctttgcacatcctctgccggggaggctctcccttcaccttcattaggttatcagatc

SEQ ID NO: 34043 - DNA, 201 bp, Homo sapiens
atctatcatttttctttcctccttcttcctctccctccctcccatcctttcttgctttcttccctcctctctccttccttccctccctttccagcttaackaaaattttctgatacttttttcctgaattagggtatgttttggggggaaaaaacgcttcagtgcgtgtttctttcgacattacacataagcccccatgga

SEQ ID NO: 34044 - DNA, 201 bp, Homo sapiens
ggaacaggaggagcagcttcctcctgggcacagctgtgcagaaccagaggcgacgcatttgcccatcgtaaaggctgattagaaacagttgggtcccaagyagaatccttttgcccatgactgtgtccatggtcgaggtgtccattgtcactgttgccagatgccagcactggcgagggttttgccttcctaccgtaggct

SEQ ID NO: 34045 - DNA, 201 bp, Homo sapiens
tgccagtgggcagaaggttttgcaagaatagcttcaggaagactttgtgggaagacagatgaatactcagggtttttttttttttttcttctaacttgtcmtccttgatcaggatttctcaaatgcacatttgtctaatatactgttgaaccatgcaagtaccaaaacaaaacaagaaacccagaattatagctcaaattt

SEQ ID NO: 34046 - DNA, 201 bp, Homo sapiens
atgtgcccaccctacgatttgaatcttctgtgccgttaagggaattggcagtgttcagacagaatggtaacattctctctgatcgtgtctgtgtctgcacscttttttgttttgtttctgttgtcttcattaatagacctttcaggaaccttcctgggatctcagataacagttcttctggaacaggattatccagaggta

SEQ ID NO: 34047 - DNA, 201 bp, Homo sapiens
agctctcctgcaaatattccattgcacgactttaaataaagcagcaagaagtcttttcattcagttcagatttgctacttgttctcttggttccttcaaaktaatgactaagtacaggtctttagatagagagctgcaccaaccaggtattgcttcgtgtcttccacgtacgtcctgagaaagcgaaggtgaatttcacca

SEQ ID NO: 34048 - DNA, 201 bp, Homo sapiens
attagaactggaaaggtgcaataacatcttaatacaaactggcgtatgttatagttactgtcagttgttgtaaactcgtcctgccgcctggactagttacrcttcccttgattagctctgagaaacgaggcagcgggcactggggcagccacatagacaacatctaaatttttgttgctttcctgggtcttgccctgtcct

SEQ ID NO: 34049 - DNA, 201 bp, Homo sapiens
ctgggaactacagttcaagatgagatttgggtggggacacagacaaattgtatcatagaatcataaaaattgctatttctaaggcagatgaataatcctgkttggaaatcatactgatttagacttaaaaccattcagccttctttaccatttctgaatgtggccctgagggaggatttgtcttttgctattttctttttt

SEQ ID NO: 34050 - DNA, 201 bp, Homo sapiens
aagtggagtgagttcatttgttcattcagcaaataggacttgagtcccctactatgtgcggagccttaaaggatgagaaagatttctgggtgggacttcartgagactcatttcgcaggttttcatgttattatgtatatgtggtaaataattaattttttcacaagtacttgcactagtgatgctaaaataagcttgact

SEQ ID NO: 34051 - DNA, 201 bp, Homo sapiens
ccattgaattttgatgatagcattaaaacaaatgcctcaaatcatttttggaaggagacaggatatgaattgacaaattaataaaataaattatacttcaragatgctaaattatctcttctatgtaagtaggaggctctcttttcagatgtggaatttgtaggagcttgaatattctcaagagagggtatgggcaacatt

SEQ ID NO: 34052 - DNA, 201 bp, Homo sapiens
tgaagcaggtatctgagaatactaaaatcttacagtgcattttataggagtgtgaatgatttttctgcaattgacatatcaaggagcttatcatctattaytaagttaccttttcctgaaacaaaatatttgtcagatgtaacttggtacccaaatgccttttcttgctaaactaggaactgtcacacacacccacccacc

SEQ ID NO: 34053 - DNA, 201 bp, Homo sapiens
atctttatataacatactcacagctcccttaggagtacttttgtccatttctacacaatggaaacttataattttagccttagcaacatgtatttactggrcatctagatttcatttatttaagaactttttattgaatgccgattgttcagcagccaccatgcaaggtcctggggaaccagtgggcagccacacagagaa

SEQ ID NO: 34054 - DNA, 201 bp, Homo sapiens
ttcagtagtttcacctaataaaacatggaatcattctacgcatgctgttctgtattgtagtatggttttccacactgagaacatactgtgaccatgcagtmatttcccagatggaacttattgagggacattcacttagtttcgaaaggtttctccctccactcccatcccggccacagatagtgatgcaataacatcctt

SEQ ID NO: 34055 - DNA, 201 bp, Homo sapiens
atttgtatcaaggacggttggtactttaatcatcaataaactaacatctcaacagcctgccataaatttcttgtcaaaaaaagaggttatgattagaatamtgtgattaaagagaatttgtagatagacttacatccctcagtttcaaagcttctagtagtagggcttagaggttcctagagtaggaaaagcctagccaag

SEQ ID NO: 34056 - DNA, 201 bp, Homo sapiens
ggatccataggacattttgaggaattgggtgtggggagtggagggagtgaagtgacccagatagggaggtgcttgatggcttgactgtggccttcaccttsctttttgtggagctggatatagacatttgttggccagctaatactgtcttgatctgttatatgatccttaggccaggactttttcctggtaattgtgcaa

SEQ ID NO: 34057 - DNA, 201 bp, Homo sapiens
atgatgaaaataatagaatattgatgagaacacccattactctgctcattgttcaaatgaactcatttgagagctctctcctttgtttctgtctttctctygcatcagcttgcatctgtttgcctatgctataaggcatcagtggttaccaggcagtgttgcattttttccatcccatacctctgtgtgtgttccttatct

SEQ ID NO: 34058 - DNA, 201 bp, Homo sapiens
tctcaaacctgaattatacccggcctcagggtataggggtcaggcagctgtttgacaggattcttgcaaatgtttttggtttctctgtctactcattacgyacactctgccagaggttgaaaactcaatgttgagattacatacatcctgaaaacactgtttaaataaaattttggcctgcatcctgtttttgaaaacttg

SEQ ID NO: 34059 - DNA, 201 bp, Homo sapiens
ccaaaacaaaggtcaattttttttccacattcatctataaaacaataaaggaaacatcctagacacttgaatcagagcccttttaattatgacttcaaaamacagggctcgtgccacccaagatttcctccatatacaaaaaaaaaaaaaggaaaaagggaagaagcaaaggggcaatacagggctctgcccattagaatc

SEQ ID NO: 34060 - DNA, 201 bp, Homo sapiens
tttatcaggttaggaagaattctgctttttgctttcccaaacggactgctttggtctttcctcacgcttggcagaacagtgaaaggccagtctgtcatgaygtttgaatgctgaatagtataaccattgtggcatagagggcgggaggctggacttgaaatgggtgagctggattctcccaccactcgggagttaatggca

SEQ ID NO: 34061 - DNA, 201 bp, Homo sapiens
ggactggcttgttggcagagatggcagagatggcagagatatgaactatctctgaaagggcattctgcatgccacagttaagtgctctgttgaaggacggstctggaagggagcatccgcgaaatgaataagaaggtggttattagtgaggtctccctgaaaggagcatagctggatgcaatccttggaggccctgtctag

SEQ ID NO: 34062 - DNA, 201 bp, Homo sapiens
cattgtggacacaccatttatgttagtggaatctggtaagagtgattgaggagagagcattgggtgaatgaccctgtaatccttataaaaatagtagcaayggtaactaatgatgtttatgaactgcctaagaatgccatgactgtgtcaagcacttcccataactagctcatgtaaagcctgtaaccatcttgggggtga

SEQ ID NO: 34063 - DNA, 201 bp, Homo sapiens
aatgcagaatattcctaatatagtttgatagttcctcctcaagacttatcattcaaagattgggcaaattgacttgaaagagaaaagttaagctatttccstaataccaaggcaatgcaggtcagctgcagtgcctaatgtttataaaacttgtaaatgttgaaacccacacttggtctgagagaacatcatgctccagtt

SEQ ID NO: 34064 - DNA, 201 bp, Homo sapiens
gatatcagattcatacgccagaaccagaagaccactcgtgagaaattctgtaagcacaggagtgtggtttatgtcaaaatcaatctgatggagtgaagccmttccttgccaagcgaaaatacagcatcatcaactacatccttgagcctagaacctcttcactcagcaccagctagtgggtaaagcccgggagaggttgta

SEQ ID NO: 34065 - DNA, 201 bp, Homo sapiens
ctcaaagtcccaacgtgctgggattacaggcatgagccaccacgccctgctaaggtggcaatctttatacataaaaaacaggaatgacttcttcgaattgktgcactagagaaatgttttccagtcgcctaagcgtttaagcatggtaaacagattaccatattagttgcccagaccttgcaaaacttcatagtgtttgtt

SEQ ID NO: 34066 - DNA, 201 bp, Homo sapiens
atgagatttggtggggacaggcaaaccagatccaaaccatagtgactatgatatatctttcacatttctctttacaaaaagaaaaacaatgtaaggtcccrtgacaattagccttactgccggggagaccataaggagtggtggagactgtggtaaactgcagcgcgcacactctgttaacagaggaggtcactttccatt

SEQ ID NO: 34067 - DNA, 201 bp, Homo sapiens
cacacacctatgtttttctttatgtgtgttaaaatctccctctacccctttcctttagcacctaattcctcttctgaaccgatgttatttcctggtgcatscttctagacattattatgcatttacaaggcaatatgtttgtatattcttctgccctccccttcactttgctatacacaccttgctctttttgcttgacaa

SEQ ID NO: 34068 - DNA, 201 bp, Homo sapiens
cgtttggcagagcctgtgctaagacatcatagatttccttctgtgttgtcttgagagcagagaaggtggcaggttaaagggaatcaggaaagaaatgagartgaggataaacgagagggtgtggttctcagggtagaatgcatcggacactgcctagtgtgagaagggactcatctgttttctaggaagtactataaaaaa

SEQ ID NO: 34069 - DNA, 201 bp, Homo sapiens
actggcaggatggttaatttgatgttgaaatgtcacacaatatgtgcccaccctacgatttgaatcttctgtgccgttaagggaattggcagtgttcagamagaatggtaacattctctctgatcgtgtctgtgtctgcacccttttttgttttgtttctgttgtcttcattaatagacctttcaggaaccttcctgggat

SEQ ID NO: 34070 - DNA, 201 bp, Homo sapiens
atcaaaggacctcttttcattgttcttttattgtttattgacttcaaaaaagactttttagtttaaactgactgtaatgtctcttgaatggtcttttgtaraatgactttgaaaactcggggataatgtcttcattaagtggagaaaaatcttggggaaaatataactgtaacttggctttcattagagtagaaagagata

SEQ ID NO: 34071 - DNA, 201 bp, Homo sapiens
ctattctggggaataggtggatattatacatttatttaggtggaatggtgggtcagatggcttcatgtctttttacatcacagttccacagccctcattastgaagcagaggttgaaggaggtcacttgctttttatcccaatgtcaaataactccataattttttttattattttttgagacagagtcttgctcttttgg

SEQ ID NO: 34072 - DNA, 201 bp, Homo sapiens
tgcatcgcttaccaatatttcatctgtttcacttagctgctgttacttactcaataatgtgtggccaatctcacaagatactaattctttttttcaaatgsagcatcgcttgaagctgtgataaaatatcacacctttggaaatcaaggctcttcttgtttatttatttaactcacattaattagccttaatttaaaaaaa

SEQ ID NO: 34073 - DNA, 201 bp, Homo sapiens
gttcgtggcctctggaagtccagtttttctgagctcaggggagccttggttgtatcttataggcaagagacgaatttacattttgccatggtgttaacaarcaaaagaagacaaaagagctcaaaatagacagtggcgtgctggggtcaggggtgctggtcaccagggcgagcagttatgggtgaagggctgaatttgcag

SEQ ID NO: 34074 - DNA, 201 bp, Homo sapiens
tgagtcttaaacctctgcgtggtgtgcaagttgaggcctggtgtatgcacttcggccacgggctttcccactgtaatgaagatggaatgactccatggatsacctttccgtgcctttgtctgtagcctgccctcctctttaactgaacaccttccagacgagcatgctctgaactcctgaactgctcattctgttctctga

SEQ ID NO: 34075 - DNA, 201 bp, Homo sapiens
cagagaacatggaagcatctcatggcagcagtcacaattttgtgttgcgtaatatttcaggaacttgcaaccctgataacttgtgcctgcctgtctgtagrcctttaatgatgttttattgaattttggttttcccctagactttgcagtgcatgacacatagtaattgctcaataaatatgtgttcaactgaactatggt

SEQ ID NO: 34076 - DNA, 201 bp, Homo sapiens
ttagggggagaggttagagtagaattttaaagagtgcatttctcttccagtaagcaattctgcatcgataaaaagtggagaaagaataagtgaaaaaatawttagttaattcttgttgacagaagtaggacttcaggtccacatatatttcattgtagagtgcacacatgcatttttaagaatttcccgattctcttccac

SEQ ID NO: 34077 - DNA, 201 bp, Homo sapiens
agttgaataggaccgtagaggtggcctaaggcagccttccattcagggcacgcagatttggttcctcagctcccttcttctctatttctgagtcacgtggsctgcacctatctgtcagaagcccactgcccacccagagcccctgactctgaatggtggcccagtgctttctgaagacagaggtgggacctggtgctggag

SEQ ID NO: 34078 - DNA, 201 bp, Homo sapiens
gtcacttgagttcttgttgagtgttctttcctgctgaggtgtcctaggtgcctcttaatgcctttaacatctgctaagagtatgtcacttattgacgtagyatcactttattgagcagctactatgtaccaaacacttagcatatgctttttggcattaggagctgaacccagagtggtctctgtggagaggtgcaggttt

SEQ ID NO: 34079 - DNA, 201 bp, Homo sapiens
tttgtagagggaaaacagcttagcaagcatttagtaggtagatccaaagtccccaggagctgttgggaagtccataggtgctgtttccattgctttttcaytccttcatatattaatcaaggagtcagtcaatcaattaaacggatactattagcacctactgtgtgccgggcactgtacttggggccatatgcactgctg

SEQ ID NO: 34080 - DNA, 201 bp, Homo sapiens
ctgaagccattgcccatctgttcaactgttgtattcacgaggaggttagacccctgacccaaggcccaggtacctggctttcctcagttgggatcagaagrccacaaagttttcttatattttaagcatcaaagtagcaccactgtacagcatctttacttaatctgccctctttcacgtgtgtgcatccctggcatgctt

SEQ ID NO: 34081 - DNA, 201 bp, Homo sapiens
gaatttgccaaacatgaataggcacttacaatgtgactggaattggctctgtcatgtgtcagcctaatagcctaaaccctggttcaatacaatgaacttgkgaaggtttgcttaatgaaagaactgacgttttctgtgcagcggctgcattcatcagcctgcatcctgttcattacactacaaagggctgccaatgggaat

SEQ ID NO: 34082 - DNA, 201 bp, Homo sapiens
tacgcaaaagcaggaacatcatctgcttttgggtagttaagagttaagtatcactttgagctacaggatcatgattaaaaagcattctgttatcttacttyacaactctccacttttgtaaaagtttaggataccggcagggcagcaaatacctttaaatgattttatttaaatgtcagatttaattaaatccatgaccag

SEQ ID NO: 34083 - DNA, 201 bp, Homo sapiens
atcagtagaagagtacaataaaacaggaattttcagagcatgtaatttcttcttggaagtgaaaggcactggagaatggtgcagaataagcactagccttwgagagaggatgccctgccccagtctctttctctgagtagcagagagctggctgtgctaggaaactcttcgcctctctaacaccacgtttattctccagcc

SEQ ID NO: 34084 - DNA, 201 bp, Homo sapiens
aagaaaaataaacaagaacaaatggagaatctttcactatgactgcaactgaaaagaggagtaatggaaggacatgtactcttcccatatatttttaaacrattactgtatctgatttttcatttttcattttttttttttctggaagaaagagcagatctggataaagtcagtatacaatgtggtctttggtgacagacc

SEQ ID NO: 34085 - DNA, 201 bp, Homo sapiens
ccaagattttagtggaaagggaaagcatatgatctagtacaaagaattttttttagcttcttctccgctgcttgtttaagaatctcagagtaatccagacrttactactccataagcaaatctgggacagtaatcagacaaccagacaaccagactgagagcccccaagggttcaaattcctgagcgccgtgtcttctcta

SEQ ID NO: 34086 - DNA, 201 bp, Homo sapiens
ccctccatctgggtgctttccagtcacagcctggatgcatgtatgaataaacttctaccattaagtccctgaattatttaagcactgccagtgattctatrtaaaccgttcagtaaaatgaatggcatatgcgtatgtttcaagagctccagcagcctacccaggatggcttgatgttgtctcttagcaccgtatcaatac

SEQ ID NO: 34087 - DNA, 201 bp, Homo sapiens
tcacttctgattgtcagtgactttggtgagttcttaccttgtaaaagatttacaattatttcattttcaacatagctttatcttatgacaaaggtgacagraaggaaatctcctaagttggcctacagggtgctttagaaaacatctggctgggcatggtggttcacacctgtaatctccacactttgggaggctgaagta

SEQ ID NO: 34088 - DNA, 201 bp, Homo sapiens
gcacctacatgcgtgggaactgataagatgggggttgtgtccacttcacttgtatgggatgtcggtgctttgaaaaaattctatcatcaaagagtaggttycttagttctgcaaatctggcacctggagatggcattttgaatcggacgacctttttagtaagggtcacttgctgttggatcatcgaagggggtgctgagt

SEQ ID NO: 34089 - DNA, 201 bp, Homo sapiens
aatgaactttcttgctcctggatttttggctcttggccttgtaatttttttttttcatgggatattagtcaacatgatgtgagcagagtcttgagatgtgyttgcatgattggctttgtactcctgcatttttcccatagccaatgccttttcttcagcttgggctgcagaatgagatagatgaaacagacctgaatctga

SEQ ID NO: 34090 - DNA, 201 bp, Homo sapiens
ccagtgttcctaacaatgcgcctattgacttcttatttcaatagatatccagattgattatccctcaaggtaagcatcgattttacctttgtctcagtcartatttacctctgaggtcaatacgtgtggatattcacctcagctgcagtcaatatccatttcgtattacaatatatgatgtgcatatgtgaaaataaagaa

SEQ ID NO: 34091 - DNA, 201 bp, Homo sapiens
ttctagagcgtctttcatctgatttcctccaccatctggaaccttctggattcttcctcttatgggtagtgatgggcactttaggagtaggaatacatgtsagtgctagaccacatcctttcatacccggaattcgcatagtgacatttaaaaatagatagcaggccaggtgcggtggctcacgcctgtaatcccagcact

SEQ ID NO: 34092 - DNA, 201 bp, Homo sapiens
tacaaattgaacattgactttcctcattttttatccagttttgctttccagagacccagatatggcttcattttttaaatgaaattttgcaggtcattagstcataatgattaaatgattctggttattagcataaaacacagctgtagtacataagaggtaacctttattgtttaaatattattcaatgtgcctacatag

SEQ ID NO: 34093 - DNA, 201 bp, Homo sapiens; identical to SEQ ID NO: 27116

SEQ ID NO: 34094 - DNA, 201 bp, Homo sapiens; identical to SEQ ID NO: 27117

SEQ ID NO: 34095 - DNA, 201 bp, Homo sapiens
cagaggaaaactgcctgttgtagttaaaaaaaaaaagagagagagagagagagagactgatacacaaagagaatcagaaaggagtagagatgaaacaaagrtagagctagcatgattgcaagctgaggacatacgaggagtccctgggtcagctgggccatacatttgtaagctgtagacaaacaaaaatgatctttgggt

SEQ ID NO: 34096 - DNA, 201 bp, Homo sapiens
tgataagagcttcacgcagatgacatcaaagcaccatgtgtgggggaagcacgatgatcttgaccattttacagatgaggaaggtaaggctcggtgtcatmaactcacagaggaagtggagctggagtctctgtggctccagggtcaggtgtgtagtctcgaaggctgttttctgttctgcaagtttctccttaacacatt

SEQ ID NO: 34097 - DNA, 201 bp, Homo sapiens
tttcatgtcgaatatgtagatttacaatatgtgaattatcatcagaagaatgaggttctttgatgattgttgcagataccctgaagaactggcccttgttstagaagaatggcacagggcacatggtaaaatggccctggccattcctttagacattttgtttgtacttatattaacttgagagaaagtattaggaaaaac

SEQ ID NO: 34098 - DNA, 201 bp, Homo sapiens
aaataaatttctattgttttaagctaccacacagatgcaggaaactaatataccctttaatgattttctccatggcctttctgataatcctttcatccttyatctcccctgttgccgttttctttgctttgctttgcttgcttgctttttttttttgagacggagttttgctcttgtcgcctaggctggagtgcaacggca

SEQ ID NO: 34099 - DNA, 201 bp, Homo sapiens
ctgctcacgtcggcctcccagagtgctaggattaaaggtgtgagccaccgtgcctggcctctttctgtttcaaagaaatagtcaagaagtttctagatgcrcacaaaatgaccaaaccagtctttccgcttatttacacaatgaagaaacatcagagttcaccctggaagacagagtttctttctgtcttcatcctagggc

SEQ ID NO: 34100 - DNA, 201 bp, Homo sapiens
tcacaaactactaggatttcttgggtgcttaccatgtgccatatttccttgaatcttcatgacgatccttcaagggatccttgttttctaaagggtaaagstgcaggttagaggctatgtcagaagcaagtcaggatttgaaggcagatctgtctgcttttgcccctctgtaaatccagagctgctgcctcatttcttacg

SEQ ID NO: 34101 - DNA, 201 bp, Homo sapiens
agacccctgacccaaggcccaggtacctggctttcctcagttgggatcagaaggccacaaagttttcttatattttaagcatcaaagtagcaccactgtasagcatctttacttaatctgccctctttcacgtgtgtgcatccctggcatgcttaaacaagaaaggcaaatgagagagagcgagtgagtgcgagcgagaga

SEQ ID NO: 34102 - DNA, 201 bp, Homo sapiens; identical to SEQ ID NO: 5357

SEQ ID NO: 34103 - DNA, 201 bp, Homo sapiens; identical to SEQ ID NO: 5465

SEQ ID NO: 34104 - DNA, 201 bp, Homo sapiens; identical to SEQ ID NO: 5466

SEQ ID NO: 34105 - DNA, 201 bp, Homo sapiens; identical to SEQ ID NO: 5467

SEQ ID NO: 34106 - DNA, 201 bp, Homo sapiens; identical to SEQ ID NO: 5468

SEQ ID NO: 34107 - DNA, 201 bp, Homo sapiens; identical to SEQ ID NO: 5469

SEQ ID NO: 34108 - DNA, 201 bp, Homo sapiens; identical to SEQ ID NO: 5470

SEQ ID NO: 34109 - DNA, 201 bp, Homo sapiens; identical to SEQ ID NO: 5471

SEQ ID NO: 34110 - DNA, 201 bp, Homo sapiens; identical to SEQ ID NO: 5472

SEQ ID NO: 34111 - DNA, 201 bp, Homo sapiens; identical to SEQ ID NO: 5473

SEQ ID NO: 34112 - DNA, 201 bp, Homo sapiens; identical to SEQ ID NO: 5474

SEQ ID NO: 34113 - DNA, 201 bp, Homo sapiens; identical to SEQ ID NO: 5955

SEQ ID NO: 34114 - DNA, 201 bp, Homo sapiens; identical to SEQ ID NO: 6050

SEQ ID NO: 34115 - DNA, 201 bp, Homo sapiens; identical to SEQ ID NO: 6051

SEQ ID NO: 34116 - DNA, 201 bp, Homo sapiens; identical to SEQ ID NO: 6052

SEQ ID NO: 34117 - DNA, 201 bp, Homo sapiens; identical to SEQ ID NO: 6053

SEQ ID NO: 34118 - DNA, 201 bp, Homo sapiens; identical to SEQ ID NO: 6054

SEQ ID NO: 34119 - DNA, 201 bp, Homo sapiens; identical to SEQ ID NO: 6055

SEQ ID NO: 34120 - DNA, 201 bp, Homo sapiens; identical to SEQ ID NO: 6746

SEQ ID NO: 34121 - DNA, 201 bp, Homo sapiens; identical to SEQ ID NO: 29326

SEQ ID NO: 34122 - DNA, 201 bp, Homo sapiens; identical to SEQ ID NO: 29327

SEQ ID NO: 34123 - DNA, 201 bp, Homo sapiens; identical to SEQ ID NO: 30895

SEQ ID NO: 34124 - DNA, 201 bp, Homo sapiens; identical to SEQ ID NO: 31959

SEQ ID NO: 34125 - DNA, 201 bp, Homo sapiens; identical to SEQ ID NO: 32189

SEQ ID NO: 34126 - DNA, 201 bp, Homo sapiens; identical to SEQ ID NO: 32190

SEQ ID NO: 34127 - DNA, 201 bp, Homo sapiens; identical to SEQ ID NO: 33393

SEQ ID NO: 34128 - DNA, 201 bp, Homo sapiens; identical to SEQ ID NO: 33394

SEQ ID NO: 34129 - DNA, 201 bp, Homo sapiens
gttggattcccttcatccccatagtcaccttcctcactttgcacaggttgtactttgcctcttcgactgtaacgcgatcaacagcaacacagcccttgggwcacagaccaggcagaaatgctcacctgtcttgatgccgatgacatccgtgaatccagcagggtatgtgatagccactcgaaccttgccatcaattttaat

SEQ ID NO: 34130 - DNA, 201 bp, Homo sapiens; identical to SEQ ID NO: 30008

SEQ ID NO: 34131 - DNA, 201 bp, Homo sapiens; identical to SEQ ID NO: 30009

SEQ ID NO: 34132 - DNA, 201 bp, Homo sapiens; identical to SEQ ID NO: 31163

SEQ ID NO: 34133 - DNA, 201 bp, Homo sapiens; identical to SEQ ID NO: 31398

SEQ ID NO: 34134 - DNA, 201 bp, Homo sapiens; identical to SEQ ID NO: 31808

SEQ ID NO: 34135 - DNA, 201 bp, Homo sapiens; identical to SEQ ID NO: 32657

SEQ ID NO: 34136 - DNA, 201 bp, Homo sapiens; identical to SEQ ID NO: 19431

SEQ ID NO: 34137 - DNA, 201 bp, Homo sapiens; identical to SEQ ID NO: 19432

SEQ ID NO: 34138 - DNA, 201 bp, Homo sapiens; identical to SEQ ID NO: 19433

SEQ ID NO: 34139 - DNA, 201 bp, Homo sapiens; identical to SEQ ID NO: 24334

SEQ ID NO: 34140 - DNA, 201 bp, Homo sapiens; identical to SEQ ID NO: 24722

SEQ ID NO: 34141 - DNA, 201 bp, Homo sapiens; identical to SEQ ID NO: 25059

SEQ ID NO: 34142 - DNA, 201 bp, Homo sapiens; identical to SEQ ID NO: 25205

SEQ ID NO: 34143 - DNA, 201 bp, Homo sapiens
tgtctaataattttcttgggattctttttagaagtgaataactaggctggaccaaagaaatatttttgaactcttggcaaataatgcaaatttgcattccmgtgcataagaacgtggatttcttaatttactttctcatttgggataccaaggttaaaagttaatgctgccaatttgccccaccaaaaagaagcacatcac

SEQ ID NO: 34144 - DNA, 201 bp, Homo sapiens
cctaattcccccacctggaggcaagtggtataaatttttttgtactttcttctaaagatttttcatgtcctatatactttaaaaatcaattttatatttcrcttttgttcatagaacactatgttgtgaggattttctcaatattcatataaactcatcaaaacattccttattccatgaaatggctgtgttaaatagact

SEQ ID NO: 34145 - DNA, 201 bp, Homo sapiens
caacatttctgaacataaagttaatatgttaaagttaatatgaagaaagtttcaaaaatatggaaacacgtaaagaagaaactacatatcactcctaattyccccacctggaggcaagtggtataaatttttttgtactttcttctaaagatttttcatgtcctatatactttaaaaatcaattttatatttcgcttttgt

SEQ ID NO: 34146 - DNA, 201 bp, Homo sapiens
tggcatgggatgaggtgctgtcttattttggtttatgccagtagcagcctgtgaaaaaaaaaaccagaggcaagcggtttttttaaggtggtgatcccagwtatcagcagtagggcggtggggaagtgagagaggaaagagatggaatccaatccaaggtgccttgacaagggagtatcctctgtggacaactggagctgg

SEQ ID NO: 34147 - DNA, 201 bp, Homo sapiens
gcgcattcctaaggaattgattccagaagccattgagaagtacttaggaggaacagatgaccctgtcaagaagaaagacctgttcctggacttaatggggracgtactgttcggtgtcccatctgtgactgtggcccggaaccacagaggtgagtcctagaggtcgaacaggggagggatatggaccccaccagcttctgt

SEQ ID NO: 34148 - DNA, 201 bp, Homo sapiens
cacccacggtgattgatggagtggtgctgccaaaaacacccgaggagcttcaagctgaaaggaagttccacactgtcccctacattgtcggatttaacagraaggaatttggctggtttcttccaacagtgagaaggcgcaggcctcttggagggactcacccacccccatcagccctcccacctctgatcccaggagtgc

SEQ ID NO: 34149 - DNA, 201 bp, Homo sapiens
ttattcatcaaaggtaaaacctaaaattaggacatggatcaatatactgtgagttcatcactgattcttttattcatgattttctctctaatagggaatcwcgtcctagtctaggctccttgagtgatgagggttccgtacctcctcaaagccacccatggatcaataacagctctcatttaaatagagatagatagcaca

SEQ ID NO: 34150 - DNA, 201 bp, Homo sapiens
acacagttccagttaggacccagaacccacacctgtgggtctagaatatcttctgccattcctgctgtcctcacatattaggacttggggacctttatgaytgacggacagctgtggcagtctctcaacacagggaagcccagcaggacaaacacccagatgacacagcacccagggccattgggaactattccctttgag

SEQ ID NO: 34151 - DNA, 201 bp, Homo sapiens
tggaaactcctggctgtgccacagatgcctcactcagctgagaaaccccatctatgtcttgcaagggacgagaccctgtttttctttagaactcaccattraagcacatttgctactttctgaagtggtcctgtgtgaatcatcttatctaggcctcctgcaattctgcacatctttattgtgtggaagacatggcactct

SEQ ID NO: 34152 - DNA, 201 bp, Homo sapiens
tatcctctgtggacaactggagctgggaaactcaaggaaacactgagaatacagcactcaggggcatcccatctgagcaccaagggagctggggtatttayccaccagctcccacttgtcattgtttgaaggctcttgcaaggagttgtttattccctgtgactttgacctgctgcacacaagggcagagtagtctcttgt

SEQ ID NO: 34153 - DNA, 201 bp, Homo sapiens
tgtcttctcagatgctggagcacccacctacatgtatgagtttcagtaccgtccaagcttctcatcagacatgaaacccaagacggtgataggagaccacrgggatgagctcttctccgtccttggggccccatctttaaaaggtaatggctccttgctctccgtgagcttggagttaggagatctgggttcctgtcttgg

SEQ ID NO: 34154 - DNA, 201 bp, Homo sapiens
ggttccgtacctcctcaaagccacccatggatcaataacagctctcatttaaatagagatagatagcacaatctctcctcattaatcatggattctgcgtytataaattcacctgcttcctaaaatgtccttataacccccaaatcgatactggtggcactttcatggtcacacacaggcaggtacagagtaggggaatct

SEQ ID NO: 34155 - DNA, 201 bp, Homo sapiens
caaattgaagtatatagacatgtaattttatatagataatacatgtatttcagtctgagtgaagatttcttcctctcctcgtcacctgaccagtgtcagcytctgcctgaagttctgcccctgagtcacacatctatcctccttagttaggaccctgtgtgtgcatacccatggcccaaagtcacgccggtctagggtgct

SEQ ID NO: 34156 - DNA, 201 bp, Homo sapiens
gaaggcgcaggcctcttggagggactcacccacccccatcagccctcccacctctgatcccaggagtgcttccctctccaagcactgctctgagtcctggrcagctgttcccttcagcaggagttaacatttccatggaaaccttctccaggagggcacagttgtcaccgggatatcagggccctgggatcccctctcccc

SEQ ID NO: 34157 - DNA, 201 bp, Homo sapiens
gctcatgcctgtaatttctgagagtgatgtggccctcactcctgctctggtggagaagggtgacgtcaagcccctggctgaggtaggtctcccgctggatscccccaaccccttggctctgtgcttctgaattctcagaggttattcttgccatgggttctagctgatgttctcctagaatcactgaagcgattgggaggt

SEQ ID NO: 34158 - DNA, 201 bp, Homo sapiens
atctttattgtgtggaagacatggcactctcccacatgtattaactcatgaggtaggtgcagtcattattaccatccatgagtggagaaaccaaggcccaracaaatcaggtggactgcctgtggcctaatggctggtaagtggagcagccaggatttggaagcagacaagtaaattcaagattccatcatctcaacccca

SEQ ID NO: 34159 - DNA, 201 bp, Homo sapiens
tcaagctttctgaagactgtctttacctcaatatttacactcctgctgacttgaccaagaaaaacaggctgctggtaagttgtgggatcccctggtcaagrcgtgtcagtgccagtaccccagatattctagtgtagatcggaaggggatgaaggcagcttggggagggagctgcacaggccaggattgtttcaggacccc

SEQ ID NO: 34160 - DNA, 201 bp, Homo sapiens
ctgggacaatcccagaagctcttccttttgcctttggccaaatatctgggatttttttgtacctaatttccctccctaattgtgttggcaaagggtgatgwcccaatgtgtcagcatttgccaaataaacaaacggcaggagatggggctggctgccagctgcagggttgggagtgtctgctggcaaagaaggccacccca

SEQ ID NO: 34161 - DNA, 201 bp, Homo sapiens
gctcttccttttgcctttggccaaatatctgggatttttttgtacctaatttccctccctaattgtgttggcaaagggtgatgacccaatgtgtcagcatwtgccaaataaacaaacggcaggagatggggctggctgccagctgcagggttgggagtgtctgctggcaaagaaggccaccccaaggtgaaagaggaaggg

SEQ ID NO: 34162 - DNA, 201 bp, Homo sapiens
gttctgtcagaatgatcacctttattttattgctgatactcgtccggtggtgtctaaaccacaaaaaagggggagtatgatgaggcgtgtctgacctcctrtctgtttccaggcaggaactcagtttagggtttttctggggtccccttagcccagagagggtctgttcagtgagttaggggtgttaggattttattttta

SEQ ID NO: 34163 - DNA, 201 bp, Homo sapiens
tcacctcttagatgagaaaactgaggcccaaacaggtgaaactcccagccagtaagtagcagagccaggcttcagatccagttaatctggtttcaaagtcyatactctgttttaactgtacccagaaccagctgccctgatggcaatgcgtgaatcaggctctcgctaatctgtgaccatacaaaaattattcatcaaagg

SEQ ID NO: 34164 - DNA, 201 bp, Homo sapiens
tccttggacctgaggctactcctgggtcccaggtccggctgctaccactggactctgcttgtgtttacatgggttgagtccaatgtggtcttggagcttargtcttggttcaagctctaaatgaccaaagtgttcaaggaattaaaacacaactgctttctaatgcctggaaggaggcaaacattccagcaattctgcatg

SEQ ID NO: 34165 - DNA, 201 bp, Homo sapiens
tctggctgaacttcaggggttcttctttccccctccgcaggtgcacccaagatcccaaggtagggcagtttctctcagaactattgaccaaccgaaaggaraacattcctttcaagctttctgaagactgtctttacctcaatatttacactcctgctgacttgaccaagaaaaacaggctgctggtaagttgtgggatcc

SEQ ID NO: 34166 - DNA, 201 bp, Homo sapiens
atgaaggcagcttggggagggagctgcacaggccaggattgtttcaggaccccagggcctctacaggaaacacaggttttccacacgtcagtttcccctcrtgacatagggactctgggggagtttgctgtgcctctttaatgaacatcttaattgttccaagttccctcatgataatagaaggatgagaatgattacctt

SEQ ID NO: 34167 - DNA, 201 bp, Homo sapiens
agggtgatgacccaatgtgtcagcatttgccaaataaacaaacggcaggagatggggctggctgccagctgcagggttgggagtgtctgctggcaaagaaggccaccccaaggtgaaagaggaaggggtgtcaggtccagtcagtctcccaggggcaccgtagcatggtgcctaggagtggcggagcaggtctgcgaacat

SEQ ID NO: 34168 - DNA, 201 bp, Homo sapiens
ggcatgtgtgcttctcgagacaatcattcatgcacagagaagtttacttcaccatgaaagagttaactgagatgaagctgagatacaagggctgccccatrggtacgcggagtgcttgaacagtccaggcttgagggtgatgggagtgaggtggagaacatgaatccttagcgtttgctatgcccatgatgatgttctcag

SEQ ID NO: 34169 - DNA, 201 bp, Homo sapiens
gtctttcctgttgtgaaaaatgagtgttttttacattagcagctctccaccccaattccaggtcacttaagagagaggctcactgtcccgtctttgcttcsatgtccctgaactcttagaaaagtaggaaaccagagtatgctgggcaaactgaccccaatgcctaggtcaggcagaagggaccctgtccctcgggagggc

SEQ ID NO: 34170 - DNA, 201 bp, Homo sapiens
ctcagctgtcatggctcactgtctgcggcagaagatggaagaggagctcttggagacgacattgaaaatggtaggttgcctgttcccgtagcccaaaccctgtaaacttggtcccagacttcttcatttcagctgtcctcttgccctgggacagttacctggggcaatttctcaagtctcaggagtctcagtatctgaatg

SEQ ID NO: 34171 - DNA, 201 bp, Homo sapiens
tcagctgtcatggctcactgtctgcggcagaagatggaagaggagctcttggagacgacattgaaaatggtaggttgcctgttcccgtagcccaaaccctgtaaacttggtcccagacttcttcatttcagctgtcctcttgccctgggacagttacctggggcaatttctcaagtctcaggagtctcagtatctgaatgg

SEQ ID NO: 34172 - DNA, 201 bp, Homo sapiens
cagctgtcatggctcactgtctgcggcagaagatggaagaggagctcttggagacgacattgaaaatggtaggttgcctgttcccgtagcccaaaccctgtaaacttggtcccagacttcttcatttcagctgtcctcttgccctgggacagttacctggggcaatttctcaagtctcaggagtctcagtatctgaatggg

SEQ ID NO: 34173 - DNA, 201 bp, Homo sapiens
ctggtgacatcacctctgacgaatcttacaatcctgtcctctctgctgccttcctggaggtcacagcactctcctaaatggtcatgggcggagtacacgarattcatccagcaaagacttaataaacacttcctatatgccaggacttgtttaggagctggtgatataggagtaaaacaagaaagactccctgccctcttg

SEQ ID NO: 34174 - DNA, 201 bp, Homo sapiens
ctcttccccagaaccctctattccacactggcttggcagacaccttccctcaccatgtcactggccactgtaggtatcccagcctgacacacacacaaaamacacacacacacacacacacactgcaaaacactgccacagcttctccacatttttttttttttttgtaatctttgcaatgcttgagtttctggatataag

SEQ ID NO: 34175 - DNA, 201 bp, Homo sapiens
accatgtcactggccactgtaggtatcccagcctgacacacacacaaaacacacacacacacacacacacactgcaaaacactgccacagcttctccacatttttttttttttttgtaatctttgcaatgcttgagtttctggatataagcccatttgattcattgattttgcccatttcagtaaaaacccatgcctttaa

SEQ ID NO: 34176 - DNA, 201 bp, Homo sapiens
gctctaatacacatgacgggggatgtgtatccatgtaccctctgcacagaaactcagaatcctggcctgtgacatcaacaagacaggcgggagggtgtctyctgcaggattcagtatgacagagttgaatgtcatcgggttgtccccccacctcctcccgctctaacatacctgagggaggatgtgtattcatgtgccctc

SEQ ID NO: 34177 - DNA, 201 bp, Homo sapiens
agaatcctgttctgtgacatcaacaagacaagtgtttggggggtctcctgcaggattcactatgacagggttgaatgtcattgggttgtcccccagcttcytcctgctctaatacacattagggaggatgtgcatccatgtaccctctgccacagacactcagaatcctgggctatgtcatcaacaagacaggtggtggga

SEQ ID NO: 34178 - DNA, 201 bp, Homo sapiens
agcttcctcctgctctaatacacattagggaggatgtgcatccatgtaccctctgccacagacactcagaatcctgggctatgtcatcaacaagacaggtsgtgggacacatgcaggggtgctctaggttgagaagccaccaatcaatttccctctcccaggagcgctgagaatgtgagtgagggtgagattagagttggt

SEQ ID NO: 34179 - DNA, 201 bp, Homo sapiens
ccatgtaccctctgccacagacactcagaatcctgggctatgtcatcaacaagacaggtggtgggacacatgcaggggtgctctaggttgagaagccaccmatcaatttccctctcccaggagcgctgagaatgtgagtgagggtgagattagagttggtgttaaccctgagtcaggtctaatgtgtgtcggtttgtcttt

SEQ ID NO: 34180 - DNA, 201 bp, Homo sapiens
gggtgagattagagttggtgttaaccctgagtcaggtctaatgtgtgtcggtttgtctttctgtctgtctctaacaaaaactcataaacctttacatttawtacatttaataattgttagtttagaaatcacaggattatgaattacggtttatagtcagcaggattcactgtgacaggattgaatgtcattggcttgtcc

SEQ ID NO: 34181 - DNA, 201 bp, Homo sapiens
gtcggtttgtctttctgtctgtctctaacaaaaactcataaacctttacatttattacatttaataattgttagtttagaaatcacaggattatgaattayggtttatagtcagcaggattcactgtgacaggattgaatgtcattggcttgtcccccagtttcctcctgctctaacacacatgagggaggatgtatatca

SEQ ID NO: 34182 - DNA, 201 bp, Homo sapiens
tgggaaggggcagcttctaaggttctagcgatcaaacttctgaccctgtgaccatagcactctgacaatgagagctctctacaaatggagaggccgccccyggagatagtgaactccccgtctctggagatatacaagcctcttgacggagataacttgggcgtcctcacacatctctgaagattgttggggacacacagc

SEQ ID NO: 34183 - DNA, 201 bp, Homo sapiens
tggaggagcaaagactggggtcttttgccaaagggattgcaggttcagaaggcatcttaccatggctggggaattgtctggtggtggggggtagggggcaraggtcatgaaggagcaagttttttatttgtgacctcagctttggcaataaaagatcttttgaaagccaaatcactgcttgtgtcttgtattagagattaa

SEQ ID NO: 34184 - DNA, 201 bp, Homo sapiens
ggctgccgcactggccagagtacaaccaggaggaagggtacctgcagattggtgctaacacccaggcagcccagaagctgaaggacaaggaagtagctttytggaccaaactcttcgccaagaaggcagtggagaagccaccccagatagaacacattgcgctgtgaacggaaggtccatccagcctcgggaacctggagg

SEQ ID NO: 34185 - DNA, 201 bp, Homo sapiens
cagaagaggagatcagacttagcaagatggtgatgaaattctgggccaactttgctcgcaatgggtgaggctcttggcaaagacacagcacagctggtgarggtggggggcggggcatgcctattgggaaggggcagcttctaaggttctagcgatcaaacttctgaccctgtgaccatagcactctgacaatgagagctc

SEQ ID NO: 34186 - DNA, 201 bp, Homo sapiens
gcaagatggtgatgaaattctgggccaactttgctcgcaatgggtgaggctcttggcaaagacacagcacagctggtgagggtggggggcggggcatgccwattgggaaggggcagcttctaaggttctagcgatcaaacttctgaccctgtgaccatagcactctgacaatgagagctctctacaaatggagaggccgcc

SEQ ID NO: 34187 - DNA, 201 bp, Homo sapiens
gttgaaggttgacacatctgacttctcatggaaaggagggaaggggcagagtcatacagggagttcagggcatattgtgggtgaaggaatgggcgctgcaraaggtggggtgtgggagcatctgaccccttcctggaggagtgttgggacccactcaccccattttctgcttgaaatctggcaagtgtgggaagcaaagat

SEQ ID NO: 34188 - DNA, 201 bp, Homo sapiens
tgatgaggcgtgtctgacctcctatctgtttccaggcaggaactcagtttagggtttttctggggtccccttagcccagagagggtctgttcagtgagttrggggtgttaggattttatttttagtttacattatacaatatttttaaaaatcctttcatgatgtcttctaagccttaactctcagctgttacagatcaca

SEQ ID NO: 34189 - DNA, 201 bp, Homo sapiens
cggtttgtctttctgtctgtctctaacaaaaactcataaacctttacatttattacatttaataattgttagtttagaaatcacaggattatgaattacgrtttatagtcagcaggattcactgtgacaggattgaatgtcattggcttgtcccccagtttcctcctgctctaacacacatgagggaggatgtatatcatg

SEQ ID NO: 34190 - DNA, 201 bp, Homo sapiens
ccaggaagactagtggctggcctggaacccattttcctgactcccagtccagtgctcccaggcatcacctctgtatgccctgggctctgcccactcccctkcttttttacattttctgctccccaaaatggcactatgggaggaggttgaaccagaacattccattatcgggaggcagagataacagggatgattagccac

SEQ ID NO: 34191 - DNA, 201 bp, Homo sapiens
tgttaaatagactttaatattcctatcctattagatgtttagcctggctgctcacattctgatactacaataacactgagttcagcctaatgtttataagwctctaaccacatgtctaataattttcttgggattctttttagaagtgaataactaggctggaccaaagaaatatttttgaactcttggcaaataatgcaa

SEQ ID NO: 34192 - DNA, 201 bp, Homo sapiens
gttaaatagactttaatattcctatcctattagatgtttagcctggctgctcacattctgatactacaataacactgagttcagcctaatgtttataagtmtctaaccacatgtctaataattttcttgggattctttttagaagtgaataactaggctggaccaaagaaatatttttgaactcttggcaaataatgcaaa

SEQ ID NO: 34193 - DNA, 201 bp, Homo sapiens
attcctatcctattagatgtttagcctggctgctcacattctgatactacaataacactgagttcagcctaatgtttataagtctctaaccacatgtctartaattttcttgggattctttttagaagtgaataactaggctggaccaaagaaatatttttgaactcttggcaaataatgcaaatttgcattccagtgcat

SEQ ID NO: 34194 - DNA, 201 bp, Homo sapiens
tagatgtttagcctggctgctcacattctgatactacaataacactgagttcagcctaatgtttataagtctctaaccacatgtctaataattttcttggrattctttttagaagtgaataactaggctggaccaaagaaatatttttgaactcttggcaaataatgcaaatttgcattccagtgcataagaacgtggatt

SEQ ID NO: 34195 - DNA, 201 bp, Homo sapiens
cagtaccgtccaagcttctcatcagacatgaaacccaagacggtgataggagaccacggggatgagctcttctccgtccttggggccccatctttaaaagrtaatggctccttgctctccgtgagcttggagttaggagatctgggttcctgtcttggtgtggtggctttcagcaagtttcttctctcctggtcttagttt

SEQ ID NO: 34196 - DNA, 201 bp, Homo sapiens
attggtgttaaccctgagtcaggtctaatgtgtgtcggtttgtgtttctgcctttatgtctctaacaaaacctcataaacctttaaatttaatataattawtaattgttaatttagaaatcacaggatgtatgaatttggaatgggagaggagactttatttttgatgtggtttatagtcagcaaagttgctatccctcaa

SEQ ID NO: 34197 - DNA, 201 bp, Homo sapiens
tgtgtgtcggtttgtgtttctgcctttatgtctctaacaaaacctcataaacctttaaatttaatataattaataattgttaatttagaaatcacaggatktatgaatttggaatgggagaggagactttatttttgatgtggtttatagtcagcaaagttgctatccctcaagctgggaaggtgcctctggccaagccca

SEQ ID NO: 34198 - DNA, 201 bp, Homo sapiens
atagtcagcaaagttgctatccctcaagctgggaaggtgcctctggccaagcccagaaacaggctcatcgaacgaggaggggttgggtagaagctttataygaacagattggctaaacatacatgttcaacacgttacagggggagcaatggatattcatgaagacagtcctgacacatgtgtattaaacaaacatgcatg

SEQ ID NO: 34199 - DNA, 201 bp, Homo sapiens
gggagaacagagtggattctttaagggtagagatgcaggcctgaacccttgcccggcatggccttcgatctttttttaatttggtgtcttattgccacaargagtgtgttctgtcagaatgatcacctttattttattgctgatactcgtccggtggtgtctaaaccacaaaaaagggggagtatgatgaggcgtgtctga

SEQ ID NO: 34200 - DNA, 201 bp, Homo sapiens
tgctcataactctcacttcttcacaaagtcctgataaaaccctataaccaggaccactggagttgaatcatttctgtcttaaacttggctttgccccatgytctgcatctgatctatatatagtgttcccatctccatcttccaatggtttgagcaatactgaacctctgtttttcatctgatttcccataactttgagtt

SEQ ID NO: 34201 - DNA, 201 bp, Homo sapiens
ttcccctttgagtgaagaccctgtattctctaattcagcactcgtgggagctttgtcggaagcaactgctgggactaccgaaaacaactgtggacacagaragggaaatgcatgtacttcaaattgaagtatatagacatgtaattttatatagataatacatgtatttcagtctgagtgaagatttcttcctctcctcgt

SEQ ID NO: 34202 - DNA, 201 bp, Homo sapiens
tggctgaatatttaagaatgttaagaaatgatggctggaggtggtggctcatacctatactctcagccctttgggagactgaagtgggaggattgtgagarcctaggatttcaagatcagcctgggcaacatagtgagatcctgtctctacaacaaaattgttttcaaaaagtgatgatactatattacaaaataacatat

SEQ ID NO: 34203 - DNA, 201 bp, Homo sapiens
catcccaaagggcagagaaagtgtttatcattgcaggcttctaaactaactgctctagttgggttcaggggcctgtctgcttctctccaggttttggctgragcagagtaaattgttctggcagagttgagccttcccaggcaagcatgttaaggatactggagtcattctagggacacagccttaagctgctagaagcga

SEQ ID NO: 34204 - DNA, 201 bp, Homo sapiens
tgtggtggctcatgcctgtaatttctgagagtgatgtggccctcactcctgctctggtggagaagggtgacgtcaagcccctggctgaggtaggtctcccrctggatgcccccaaccccttggctctgtgcttctgaattctcagaggttattcttgccatgggttctagctgatgttctcctagaatcactgaagcgatt

SEQ ID NO: 34205 - DNA, 201 bp, Homo sapiens
tttatattttttacatttttttaaagatgaaaagaggttcttggtgtattaattattgttactttgtggcttgactcaggacaaaggtgcagagaccatckcccatggccaaatctggatctatgcctgcatggcccttgagctaaggatgactttttttaatcatatgaaattcaaatttcattgtccataaaggaagtt

SEQ ID NO: 34206 - DNA, 201 bp, Homo sapiens
tacaattagggcttataaatccaagggtcttctcaggacacaaagcccagcaagtgagcagcctctgtacaccggccaggtccagtccatggctggtgatrttcttatctggagaaaataactgaaatcagtctcttatgcaatcaaagccgtagttaaggctggtgggcagggttctgttcttccgagtatccaagctgc

SEQ ID NO: 34207 - DNA, 201 bp, Homo sapiens
agacacacacacacagagaaacacacacacagacacacagagacacacacaaacacacacacagacacacacacagagaaacacacagacacagacagagrcacacacaaacacacacacagacaaacacacacacaaacacacacacacacacacagacactcctggctagtgggactacaatccttaatggagagacct

SEQ ID NO: 34208 - DNA, 201 bp, Homo sapiens
ggacacagccttaagctgctagaagcgatgctagagtttggtcgagtctctgagtgcagaggtttgggcagagttgttttgtgtgaagagatatgaagttygcccctcagaaggatttcagaggttataccaaagaccaaagccatgaaggcaggctctaaggctttcagtgtcatctgtgacaggtgggggtactaggga

SEQ ID NO: 34209 - DNA, 201 bp, Homo sapiens
tcagctccctgaatgtttgcattgcaaagagaaggctctaaggccctcaaggaaatggggttgggtggtaaattccatcccaaagggcagagaaagtgttyatcattgcaggcttctaaactaactgctctagttgggttcaggggcctgtctgcttctctccaggttttggctggagcagagtaaattgttctggcagag

SEQ ID NO: 34210 - DNA, 201 bp, Homo sapiens
gtttcaatttaagtagcaggatcagggaatggctcaataagaaggtggcatttgagccaagctctggaggaggcaggaagccagctgtcaggaaacctggrgaagcctattccaggcagagggaacagccactgcaaagaccccgatggaagtggcaggtccagctggagaggatggagtgtggggacagactggcttgag

SEQ ID NO: 34211 - DNA, 201 bp, Homo sapiens
tcaacacgttacagggggagcaatggatattcatgaagacagtcctgacacatgtgtattaaacaaacatgcatgtaacattgcccatgttcacctggtgktggagacctaatatttaaatgtattacaattagggcttataaatccaagggtcttctcaggacacaaagcccagcaagtgagcagcctctgtacaccggc

SEQ ID NO: 34212 - DNA, 201 bp, Homo sapiens
gatttggaagcagacaagtaaattcaagattccatcatctcaaccccagctccacctcacctttcttgacacattcagcttgagatgattatgtccatttyaatagagataaggtagcagagataagagactgggtaattggctcatactacaattgtgattagtaacagaggcaatgctctgcggaatccagaacccaca

SEQ ID NO: 34213 - DNA, 201 bp, Homo sapiens
gacacattcagcttgagatgattatgtccattttaatagagataaggtagcagagataagagactgggtaattggctcatactacaattgtgattagtaayagaggcaatgctctgcggaatccagaacccacacatgtgggtctagagtttcttctgctgccccctgccacttgtacaagtcaggcttagttaggataga

SEQ ID NO: 34214 - DNA, 201 bp, Homo sapiens
cagaggagtcacatgatcttagatttcacaaaggtctctgcccctggtgatcaaatagactgtaggaaacgggcagagtggatgcagctgaccagctggcrggccactgcattgccataatccaggcaatggctcctggctgcttaaggctgtagtagtggggatgggaggaatggttggagtctggatatctttgaagga

SEQ ID NO: 34215 - DNA, 201 bp, Homo sapiens
caatatttttaaaaatcctttcatgatgtcttctaagccttaactctcagctgttacagatcacatgggactcaccccatggctgctcaggatgcaccatygccactgggcatgtcccaattatgcacccttaggaggcttgagttctgttatatttcagaatgtgaattgtgggtgtgtgcaagagagagcaaccctggg

SEQ ID NO: 34216 - DNA, 201 bp, Homo sapiens
gacatgaaacccaagacggtgataggagaccacggggatgagctcttctccgtccttggggccccatctttaaaaggtaatggctccttgctctccgtgarcttggagttaggagatctgggttcctgtcttggtgtggtggctttcagcaagtttcttctctcctggtcttagtttactgattctctataacagggttga

SEQ ID NO: 34217 - DNA, 201 bp, Homo sapiens
tgcctataataatttctatcattcacaaaagctctttcctctatagttggctctgagttcctttggaaaatgtttgaatggcaaaggcaaggtcaaacccyccttttagcaagttttgcttgaccttgaagcagccatttaacaggtggattacagagccacagaaggatggcatcttcccaagtgcgcttcctgctgagc

SEQ ID NO: 34218 - DNA, 201 bp, Homo sapiens
tttgccccatgttctgcatctgatctatatatagtgttcccatctccatcttccaatggtttgagcaatactgaacctctgtttttcatctgatttcccayaactttgagttcagagttttttgttgttgttgttgttgttgtttgccaggactacacagatcttatcaactttcacttattgttgtgtctcactcttttt

SEQ ID NO: 34219 - DNA, 201 bp, Homo sapiens
cagctctcattcgcctagtctgcaagccaggaaatgtcctctctctaaccatgctggaagggtttttaaatttggaacttcataagctaaagctaaagctrtagctaaagctgatgtcgcaggtgcccagacacacctttgcacaggaaggggcaggtgctcataactctcacttcttcacaaagtcctgataaaacccta

SEQ ID NO: 34220 - DNA, 201 bp, Homo sapiens
ttgttctggcagagttgagccttcccaggcaagcatgttaaggatactggagtcattctagggacacagccttaagctgctagaagcgatgctagagtttsgtcgagtctctgagtgcagaggtttgggcagagttgttttgtgtgaagagatatgaagttcgcccctcagaaggatttcagaggttataccaaagaccaa

SEQ ID NO: 34221 - DNA, 201 bp, Homo sapiens
gtgaaaccaccaactcagctgtcatggctcactgtctgcggcagaagatggaagaggagctcttggagacgacattgaaaatggtaggttgcctgttcccrtagcccaaaccctgtaaacttggtcccagacttcttcatttcagctgtcctcttgccctgggacagttacctggggcaatttctcaagtctcaggagtct

SEQ ID NO: 34222 - DNA, 201 bp, Homo sapiens
agcttgagatgattatgtccattttaatagagataaggtagcagagataagagactgggtaattggctcatactacaattgtgattagtaacagaggcaaygctctgcggaatccagaacccacacatgtgggtctagagtttcttctgctgccccctgccacttgtacaagtcaggcttagttaggatagaacatctttt

SEQ ID NO: 34223 - DNA, 201 bp, Homo sapiens
ccctgtccctgtttatttatttgagaaacactctgggcattgattctgtccgagatcctgcacggggctctgggggcatgtgcgcttgccctgactccccractgtggagcctgcctgctctccctctgtgcccttctttctggctgcactttgcttccaatctgcatgagcaccctatctgcccctgagcttaaggactc

SEQ ID NO: 34224 - DNA, 201 bp, Homo sapiens
atcacctgagcccaggaggtctatgctgcagtgagctgtgtttgcaccactgcactccagcttgggaacaaagcaagaccttgtcccaaaatcttctcttkaaaaggagaatttatttttcaaggaaatagagatctgggaggatgggctttgtgcaaaaacaggaagcagaaattacaaaatgatgggaatcctagactc

SEQ ID NO: 34225 - DNA, 201 bp, Homo sapiens
ctttgagagcttgtttggggaaagcattcaaacttaaagggctggtacattggaggagagaaaatggggatgccaagaatttttagaatttttgagaatgyttttagaattcattggttataagcaacagtttcccagtgaccagatttaagtcaagacggacgattggctaggtgtggtggctcatgcctgtaatttctg

SEQ ID NO: 34226 - DNA, 201 bp, Homo sapiens
catggaaaggagggaaggggcagagtcatacagggagttcagggcatattgtgggtgaaggaatgggcgctgcagaaggtggggtgtgggagcatctgacyccttcctggaggagtgttgggacccactcaccccattttctgcttgaaatctggcaagtgtgggaagcaaagatggagtcctcctcatcaggtctccatg

SEQ ID NO: 34227 - DNA, 201 bp, Homo sapiens
tgggctttgtgcaaaaacaggaagcagaaattacaaaatgatgggaatcctagactctgttactcttgttctctctctgtctctttctctctgtctgtctrtctttctctctctctctcaccctctacttctccctgtccctgtttatttatttgagaaacactctgggcattgattctgtccgagatcctgcacggggct

SEQ ID NO: 34228 - DNA, 201 bp, Homo sapiens
agactctgactcagttgtcattctaggatagtcgttcgtccactcaatcattaatccatctactatgatcttcttatgcatctatgtgttcactaattcaycccattcattgatatatttttatcaatctaatatcaacctgttcataactttttatttttctattttcaatctatccactgttcatgcatcatccagcca

SEQ ID NO: 34229 - DNA, 201 bp, Homo sapiens
gctggaggtggtggctcatacctatactctcagccctttgggagactgaagtgggaggattgtgagagcctaggatttcaagatcagcctgggcaacatastgagatcctgtctctacaacaaaattgttttcaaaaagtgatgatactatattacaaaataacatatataatatcatcccaagtttatatacataaaaga

SEQ ID NO: 34230 - DNA, 201 bp, Homo sapiens
gcaggcttctaaactaactgctctagttgggttcaggggcctgtctgcttctctccaggttttggctggagcagagtaaattgttctggcagagttgagcsttcccaggcaagcatgttaaggatactggagtcattctagggacacagccttaagctgctagaagcgatgctagagtttggtcgagtctctgagtgcaga

SEQ ID NO: 34231 - DNA, 201 bp, Homo sapiens
ttttatcaatctaatatcaacctgttcataactttttatttttctattttcaatctatccactgttcatgcatcatccagccaccatatatcttaactctrtcaccccattcctccaaaaccaacaatccagttatcacctatctgttagttttcacccactattcatgtatccatccaattcaactgtactccagctatt

SEQ ID NO: 34232 - DNA, 201 bp, Homo sapiens
ctttttatttttctattttcaatctatccactgttcatgcatcatccagccaccatatatcttaactctatcaccccattcctccaaaaccaacaatccarttatcacctatctgttagttttcacccactattcatgtatccatccaattcaactgtactccagctattggtgaagccatccatccctccatttatccac

SEQ ID NO: 34233 - DNA, 201 bp, Homo sapiens
aagtgtctttcaacagaaacccacacataaaagaaggttgatgaaaatgttgtggccagaggtttgcaagaacctaacccagtatttcccctttgagtgawgaccctgtattctctaattcagcactcgtgggagctttgtcggaagcaactgctgggactaccgaaaacaactgtggacacagagagggaaatgcatgta

SEQ ID NO: 34234 - DNA, 201 bp, Homo sapiens
tatgaatttggaatgggagaggagactttatttttgatgtggtttatagtcagcaaagttgctatccctcaagctgggaaggtgcctctggccaagcccasaaacaggctcatcgaacgaggaggggttgggtagaagctttatatgaacagattggctaaacatacatgttcaacacgttacagggggagcaatggatat

SEQ ID NO: 34235 - DNA, 201 bp, Homo sapiens
gggactagaagttggccctacatgtgcttcgtgagacacaggaagtgggagaaaggtttactcattaattcattcattcttctattgtgtactcagggccycatatacacagttagacctggggcttcacggaaaggaggaacatgaacgcactccacactgcccctgccttcaaggatcttgccttttgtggggtagagg

SEQ ID NO: 34236 - DNA, 201 bp, Homo sapiens
tgggggcatgtgcgcttgccctgactccccgactgtggagcctgcctgctctccctctgtgcccttctttctggctgcactttgcttccaatctgcatgakcaccctatctgcccctgagcttaaggactctccttggttccagaaagtagtcaggctgtctttcctgttgtgaaaaatgagtgttttttacattagcagc

SEQ ID NO: 34237 - DNA, 201 bp, Homo sapiens
ccagttagtcagaggcaacacagttccagttaggacccagaacccacacctgtgggtctagaatatcttctgccattcctgctgtcctcacatattaggasttggggacctttatgattgacggacagctgtggcagtctctcaacacagggaagcccagcaggacaaacacccagatgacacagcacccagggccattgg

SEQ ID NO: 34238 - DNA, 201 bp, Homo sapiens
aacaggaaggggagagggatgggggacagggaaggctccaaaagcaggtgtcctatccagagctgtagcaatgctggctcagagttcctggcccatccttyccgtgccagtgcccactctttcgttctatgccttcaccctgtgctcaggcccagcagagccagagtccggcccacttcctctgggcccagccagctcggc

SEQ ID NO: 34239 - DNA, 201 bp, Homo sapiens
tcacctctgtatgccctgggctctgcccactcccctgcttttttacattttctgctccccaaaatggcactatgggaggaggttgaaccagaacattccaytatcgggaggcagagataacagggatgattagccacggagaggggaagcctgaatctcagtccaaggacactcaactcctcccagcacacaggagtctcc

SEQ ID NO: 34240 - DNA, 201 bp, Homo sapiens
actcacccacccccatcagccctcccacctctgatcccaggagtgcttccctctccaagcactgctctgagtcctgggcagctgttcccttcagcaggagktaacatttccatggaaaccttctccaggagggcacagttgtcaccgggatatcagggccctgggatcccctctccccagactctctgattgtcttcctat

SEQ ID NO: 34241 - DNA, 201 bp, Homo sapiens
gctttcagtgtcatctgtgacaggtgggggtactagggaggtctgcatcctcttccccagaaccctctattccacactggcttggcagacaccttccctcrccatgtcactggccactgtaggtatcccagcctgacacacacacaaaacacacacacacacacacacacactgcaaaacactgccacagcttctccacat

SEQ ID NO: 34242 - DNA, 201 bp, Homo sapiens
cagaagacagccatgtcactcttctggaagtcctatccctttgttgtaagagtctaggaatcacgggaattggctaggacccacagagcgacaaggattgmccaaattatagagcaattaaatggccgaatgaagactggggcctcagggtttctcccatctttccacctttcccacttcactttccaccctagcggggag

SEQ ID NO: 34243 - DNA, 201 bp, Homo sapiens
gtgccaactagaggaggctcacaggactcctctttttcttccagctctcattcgcctagtctgcaagccaggaaatgtcctctctctaaccatgctggaarggtttttaaatttggaacttcataagctaaagctaaagctatagctaaagctgatgtcgcaggtgcccagacacacctttgcacaggaaggggcaggtgc

SEQ ID NO: 34244 - DNA, 201 bp, Homo sapiens
gtttgagcaatactgaacctctgtttttcatctgatttcccataactttgagttcagagttttttgttgttgttgttgttgttgtttgccaggactacacmgatcttatcaactttcacttattgttgtgtctcactctttttgataaaaacaacatttctgaacataaagttaatatgttaaagttaatatgaagaaagt

SEQ ID NO: 34245 - DNA, 201 bp, Homo sapiens
ttacagggggagcaatggatattcatgaagacagtcctgacacatgtgtattaaacaaacatgcatgtaacattgcccatgttcacctggtgttggagacytaatatttaaatgtattacaattagggcttataaatccaagggtcttctcaggacacaaagcccagcaagtgagcagcctctgtacaccggccaggtcca

SEQ ID NO: 34246 - DNA, 201 bp, Homo sapiens
atttccctccctaattgtgttggcaaagggtgatgacccaatgtgtcagcatttgccaaataaacaaacggcaggagatggggctggctgccagctgcagrgttgggagtgtctgctggcaaagaaggccaccccaaggtgaaagaggaaggggtgtcaggtccagtcagtctcccaggggcaccgtagcatggtgcctag

SEQ ID NO: 34247 - DNA, 201 bp, Homo sapiens
caggttgagtatggtggcagcacagaggggaagcattcattgtagtcatcaggggtgcttcacagagaaggtggacgagccgaatttgagaccagacagcrgaattcgggaattcatgcccttaaccctgactccaccttatctttcttgagaaattcagcattgagatcattgtgcccattttaatagaggtaacagaga

SEQ ID NO: 34248 - DNA, 201 bp, Homo sapiens
attgcaggttcagaaggcatcttaccatggctggggaattgtctggtggtggggggtagggggcagaggtcatgaaggagcaagttttttatttgtgaccycagctttggcaataaaagatcttttgaaagccaaatcactgcttgtgtcttgtattagagattaatccatcctcctcagagacagaacgatgatgaaaga

SEQ ID NO: 34249 - DNA, 201 bp, Homo sapiens
aaaaactcataaacctttacatttattacatttaataattgttagtttagaaatcacaggattatgaattacgatttatagtcagcaggattcactgtgayaggattgaatgtcattggcttgtcccccagtttcctcctgctctaacacacatgagggaggatgtatatcatgtgccctctgccaccgacactcagaatc

SEQ ID NO: 34250 - DNA, 201 bp, Homo sapiens
ccatcgggctcaacagagcttcaggaggaaggataggagcctctgtctaaggcagaagtagaatttcagaaagcatagagaaagtttgaagagtttaatgktgacttacaagaaaagttaccattattatagtcaagacgaattggattttatattaatactttcaaaaacatctccagccttgaagctaagtttcataag

SEQ ID NO: 34251 - DNA, 201 bp, Homo sapiens
gacagtgcctgcccacctccatcgggctcaacagagcttcaggaggaaggataggagcctctgtctaaggcagaagtagaatttcagaaagcatagagaargtttgaagagtttaatggtgacttacaagaaaagttaccattattatagtcaagacgaattggattttatattaatactttcaaaaacatctccagcctt

SEQ ID NO: 34252 - DNA, 201 bp, Homo sapiens
ggactatgacagtgcctgcccacctccatcgggctcaacagagcttcaggaggaaggataggagcctctgtctaaggcagaagtagaatttcagaaagcayagagaaagtttgaagagtttaatggtgacttacaagaaaagttaccattattatagtcaagacgaattggattttatattaatactttcaaaaacatctc

SEQ ID NO: 34253 - DNA, 201 bp, Homo sapiens
tccacaaaaaactcatggatgcatccttgctaacaccggaaaactacctggaccaatttcctgacttgaagaatcacatcaccaagtgcagcaggaagctkacggactatgacagtgcctgcccacctccatcgggctcaacagagcttcaggaggaaggataggagcctctgtctaaggcagaagtagaatttcagaaag

SEQ ID NO: 34254 - DNA, 201 bp, Homo sapiens
gattggtctgggcaggaaggtgtgaaaatggttggtgagaaaggtgatgtgctctgggaggatatccacaaaaaactcatggatgcatccttgctaacacyggaaaactacctggaccaatttcctgacttgaagaatcacatcaccaagtgcagcaggaagctgacggactatgacagtgcctgcccacctccatcgggc

SEQ ID NO: 34255 - DNA, 201 bp, Homo sapiens
atctttgccaagaatgcctggaagagactcagccactcacaggaaaacgtcctccagaagccagggaaagctgctgagacaaaagacaaacagtttgaagwatatgtccagaacttcaagccacaagaagcagagggtaccagacctgagagaactctgaggatgtttagaagcaatcaaaggcattcaagagaccttgac

SEQ ID NO: 34256 - DNA, 201 bp, Homo sapiens
gggcatctttgccaagaatgcctggaagagactcagccactcacaggaaaacgtcctccagaagccagggaaagctgctgagacaaaagacaaacagtttraagaatatgtccagaacttcaagccacaagaagcagagggtaccagacctgagagaactctgaggatgtttagaagcaatcaaaggcattcaagagacct

SEQ ID NO: 34257 - DNA, 24 bp, Homo sapiens
tcagttcccaattctatatgtctc

SEQ ID NO: 34258 - DNA, 24 bp, Homo sapiens
tcagttcccaattctatatgtctt

SEQ ID NO: 34259 - DNA, 20 bp, Homo sapiens
ttgctccatcaaactgtgaa

SEQ ID NO: 34260 - DNA, 19 bp, Homo sapiens
aaaccagccaaattccttc

SEQ ID NO: 34261 - DNA, 19 bp, Homo sapiens
aaaccagccaaattccttt

SEQ ID NO: 34262 - DNA, 18 bp, Homo sapiens
acacccacggtgattgat

SEQ ID NO: 34263 - DNA, 15 bp, Homo sapiens
agccccagaacctgc

SEQ ID NO: 34264 - DNA, 15 bp, Homo sapiens
agccccagaacctgg

SEQ ID NO: 34265 - DNA, 19 bp, Homo sapiens
gggctgggcttgtagaata

SEQ ID NO: 34266 - DNA, 19 bp, Homo sapiens
cgggatttcaggtgtgagt

SEQ ID NO: 34267 - DNA, 18 bp, Homo sapiens
gggatttcaggtgtgagc

SEQ ID NO: 34268 - DNA, 28 bp, Homo sapiens
ctgctctttggaggaagtgaaagataat

SEQ ID NO: 34269 - DNA, 21 bp, Homo sapiens
cttcctgagaagtcaagaagt

SEQ ID NO: 34270 - DNA, 20 bp, Homo sapiens
ttcctgagaagtcaagaagc

SEQ ID NO: 34271 - DNA, 22 bp, Homo sapiens
tctctggctttctcagcactca

SEQ ID NO: 34272 - DNA, 16 bp, Homo sapiens
aagggcttcggggtac

SEQ ID NO: 34273 - DNA, 16 bp, Homo sapiens
aagggcttcggggtat

SEQ ID NO: 34274 - DNA, 17 bp, Homo sapiens
accgtgcagggtcttct

SEQ ID NO: 34275 - DNA, 20 bp, Homo sapiens
caaagtgattttgggacaac

SEQ ID NO: 34276 - DNA, 20 bp, Homo sapiens
caaagtgattttgggacaat

SEQ ID NO: 34277 - DNA, 25 bp, Homo sapiens
gaatactgaaaactcactcatttgt

SEQ ID NO: 34278 - DNA, 24 bp, Homo sapiens
catcatttccttacaatactgtct

SEQ ID NO: 34279 - DNA, 23 bp, Homo sapiens
atcatttccttacaatactgtcc

SEQ ID NO: 34280 - DNA, 26 bp, Homo sapiens
ccattaacaagcattgtactgttagt

SEQ ID NO: 34281 - DNA, 21 bp, Homo sapiens
gggaggttattgtgaactagg

SEQ ID NO: 34282 - DNA, 21 bp, Homo sapiens
gggaggttattgtgaactagc

SEQ ID NO: 34283 - DNA, 24 bp, Homo sapiens
agacagatcgatgacagattaagt

SEQ ID NO: 34284 - DNA, 16 bp, Homo sapiens
gctcatctgcatccgc

SEQ ID NO: 34285 - DNA, 16 bp, Homo sapiens
gctcatctgcatccgg

SEQ ID NO: 34286 - DNA, 18 bp, Homo sapiens
cccatgccttcatcacat

SEQ ID NO: 34287 - DNA, 25 bp, Homo sapiens
cttatgaaagatttcaaatcctcta

SEQ ID NO: 34288 - DNA, 23 bp, Homo sapiens
tatgaaagatttcaaatcctctg

SEQ ID NO: 34289 - DNA, 19 bp, Homo sapiens
ctgaagagggtcttttcca

SEQ ID NO: 34290 - DNA, 19 bp, Homo sapiens
atttctgcctggtctgtgt

SEQ ID NO: 34291 - DNA, 18 bp, Homo sapiens
tttctgcctggtctgtga

SEQ ID NO: 34292 - DNA, 22 bp, Homo sapiens
ctcactttgcacaggttgtact

SEQ ID NO: 34293 - DNA, 24 bp, Homo sapiens
tgaaaacatttaaagtttcctcac

SEQ ID NO: 34294 - DNA, 24 bp, Homo sapiens
tgaaaacatttaaagtttcctcat

SEQ ID NO: 34295 - DNA, 22 bp, Homo sapiens
ttcactgaagggctcactatta

SEQ ID NO: 34296 - DNA, 22 bp, Homo sapiens
cactacctccctctaggagaaa

SEQ ID NO: 34297 - DNA, 22 bp, Homo sapiens
cactacctccctctaggagaag

SEQ ID NO: 34298 - DNA, 21 bp, Homo sapiens
gatctcatggcttctgttcag

SEQ ID NO: 34299 - DNA, 24 bp, Homo sapiens
agttaaatgaatacactgatggac

SEQ ID NO: 34300 - DNA, 24 bp, Homo sapiens
agttaaatgaatacactgatggaa

SEQ ID NO: 34301 - DNA, 22 bp, Homo sapiens
ttgctgctgatgactttagagt

SEQ ID NO: 34302 - DNA, 16 bp, Homo sapiens
gccactggccatcact

SEQ ID NO: 34303 - DNA, 15 bp, Homo sapiens
ccactggccatcacg

SEQ ID NO: 34304 - DNA, 24 bp, Homo sapiens
cctttgtagacctgttcctctatc

SEQ ID NO: 34305 - DNA, 22 bp, Homo sapiens
gcttaagagcaacctcagagac

SEQ ID NO: 34306 - DNA, 22 bp, Homo sapiens
gcttaagagcaacctcagagat

SEQ ID NO: 34307 - DNA, 20 bp, Homo sapiens
aactggctgaactgtgacac

SEQ ID NO: 34308 - DNA, 18 bp, Homo sapiens
caggcatgacattgaaac

SEQ ID NO: 34309 - DNA, 18 bp, Homo sapiens
caggcatgacattgaaag

SEQ ID NO: 34310 - DNA, 25 bp, Homo sapiens
cagaatgtagtctcgattcttcttc

SEQ ID NO: 34311 - DNA, 21 bp, Homo sapiens
aggtaggtacccgtgtttaca

SEQ ID NO: 34312 - DNA, 20 bp, Homo sapiens
ggtaggtacccgtgtttacg

SEQ ID NO: 34313 - DNA, 25 bp, Homo sapiens
acaggagagtaacatgacagtatgt

SEQ ID NO: 34314 - DNA, 15 bp, Homo sapiens
gatggcatggatggc

SEQ ID NO: 34315 - DNA, 16 bp, Homo sapiens
ggatggcatggatggt

SEQ ID NO: 34316 - DNA, 20 bp, Homo sapiens
gcaggatgtgctgtgattat

SEQ ID NO: 34317 - DNA, 18 bp, Homo sapiens
gcagtcatggagagcatg

SEQ ID NO: 34318 - DNA, 20 bp, Homo sapiens
gagcagtcatggagagcata

SEQ ID NO: 34319 - DNA, 24 bp, Homo sapiens
acaccagaatgagaaaggtaagta

SEQ ID NO: 34320 - DNA, 20 bp, Homo sapiens
gcagtatctctctccatccc

SEQ ID NO: 34321 - DNA, 20 bp, Homo sapiens
gcagtatctctctccatcca

SEQ ID NO: 34322 - DNA, 25 bp, Homo sapiens
ctgactctgatgagaagtttatcac

SEQ ID NO: 34323 - DNA, 27 bp, Homo sapiens
gtcagaatttcatttactagaatccac

SEQ ID NO: 34324 - DNA, 28 bp, Homo sapiens
tgtcagaatttcatttactagaatccat

SEQ ID NO: 34325 - DNA, 25 bp, Homo sapiens
gatgagctgcctaaatttgagaaga

SEQ ID NO: 34326 - DNA, 21 bp, Homo sapiens
gagattacaaagggtccagta

SEQ ID NO: 34327 - DNA, 20 bp, Homo sapiens
agattacaaagggtccagtg

SEQ ID NO: 34328 - DNA, 21 bp, Homo sapiens
ctgcagctctttcagagagtt

SEQ ID NO: 34329 - DNA, 25 bp, Homo sapiens
ctatggtaggtgctgagaatatata

SEQ ID NO: 34330 - DNA, 24 bp, Homo sapiens
tatggtaggtgctgagaatatatg

SEQ ID NO: 34331 - DNA, 22 bp, Homo sapiens
aaggagtgaggaagcaaagatt

SEQ ID NO: 34332 - DNA, 22 bp, Homo sapiens
tcctcttttacttctttcctga

SEQ ID NO: 34333 - DNA, 21 bp, Homo sapiens
cctcttttacttctttcctgg

SEQ ID NO: 34334 - DNA, 25 bp, Homo sapiens
gtcacactgaagagtcaatgactat

SEQ ID NO: 34335 - DNA, 25 bp, Homo sapiens
acttgaataaagctgtatgacctac

SEQ ID NO: 34336 - DNA, 25 bp, Homo sapiens
acttgaataaagctgtatgacctat

SEQ ID NO: 34337 - DNA, 21 bp, Homo sapiens
ccaccatctggattctttaag

SEQ ID NO: 34338 - DNA, 14 bp, Homo sapiens
tgcccgtggtcagc

SEQ ID NO: 34339 - DNA, 14 bp, Homo sapiens
tgcccgtggtcagg

SEQ ID NO: 34340 - DNA, 19 bp, Homo sapiens
gctgcatccgtgtatctgt

SEQ ID NO: 34341 - DNA, 21 bp, Homo sapiens
gatgtttttcttgaatacacc

SEQ ID NO: 34342 - DNA, 23 bp, Homo sapiens
ttgatgtttttcttgaatacact

SEQ ID NO: 34343 - DNA, 26 bp, Homo sapiens
agagtgaaattttttcttttgtctta

SEQ ID NO: 34344 - DNA, 20 bp, Homo sapiens
caggcaaaaaagtcttgaat

SEQ ID NO: 34345 - DNA, 20 bp, Homo sapiens
caggcaaaaaagtcttgaac

SEQ ID NO: 34346 - DNA, 21 bp, Homo sapiens
ccccccataacattcagatat

SEQ ID NO: 34347 - DNA, 16 bp, Homo sapiens
gcgctggtgagaccct

SEQ ID NO: 34348 - DNA, 15 bp, Homo sapiens
cgctggtgagacccg

SEQ ID NO: 34349 - DNA, 15 bp, Homo sapiens
ggagcgcgcttctgt

SEQ ID NO: 34350 - DNA, 22 bp, Homo sapiens
gacctacgctccttcatctaac

SEQ ID NO: 34351 - DNA, 22 bp, Homo sapiens
gacctacgctccttcatctaat

SEQ ID NO: 34352 - DNA, 29 bp, Homo sapiens
caatgtgattacctcaaaataatatctac

SEQ ID NO: 34353 - DNA, 24 bp, Homo sapiens
cttacagaaggacatcctttacag

SEQ ID NO: 34354 - DNA, 24 bp, Homo sapiens
cttacagaaggacatcctttacac

SEQ ID NO: 34355 - DNA, 17 bp, Homo sapiens
gcaggcccaagattgat

SEQ ID NO: 34356 - DNA, 20 bp, Homo sapiens
cactccagcacatagaggat

SEQ ID NO: 34357 - DNA, 20 bp, Homo sapiens
cactccagcacatagaggac

SEQ ID NO: 34358 - DNA, 20 bp, Homo sapiens
cagcagcttttgtctgtgtg

SEQ ID NO: 34359 - DNA, 16 bp, Homo sapiens
gcctgctccctcatcc

SEQ ID NO: 34360 - DNA, 16 bp, Homo sapiens
gcctgctccctcatct

SEQ ID NO: 34361 - DNA, 21 bp, Homo sapiens
tggtgaagcagacaggaacta

SEQ ID NO: 34362 - DNA, 16 bp, Homo sapiens
ccaccagtggctatca

SEQ ID NO: 34363 - DNA, 16 bp, Homo sapiens
ccaccagtggctatcg

SEQ ID NO: 34364 - DNA, 18 bp, Homo sapiens
ggcaagcaggcttgagaa

SEQ ID NO: 34365 - DNA, 16 bp, Homo sapiens
aaatgctagcagcccc

SEQ ID NO: 34366 - DNA, 17 bp, Homo sapiens
caaatgctagcagccct

SEQ ID NO: 34367 - DNA, 20 bp, Homo sapiens
tcccagagaggaagagactg

SEQ ID NO: 34368 - DNA, 20 bp, Homo sapiens
ctcctgaaagggttgaactc

SEQ ID NO: 34369 - DNA, 19 bp, Homo sapiens
tcctgaaagggttgaactg

SEQ ID NO: 34370 - DNA, 18 bp, Homo sapiens
caactcctgggctgaatg

SEQ ID NO: 34371 - DNA, 12 bp, Homo sapiens
cgcggccgaagc

SEQ ID NO: 34372 - DNA, 12 bp, Homo sapiens
cgcggccgaagg

SEQ ID NO: 34373 - DNA, 18 bp, Homo sapiens
gatgacccggacgactac

SEQ ID NO: 34374 - DNA, 23 bp, Homo sapiens
ctgctgaggcaattaactaaata

SEQ ID NO: 34375 - DNA, 22 bp, Homo sapiens
tgctgaggcaattaactaaatg

SEQ ID NO: 34376 - DNA, 24 bp, Homo sapiens
tggaacaactttattcgaagtaag

SEQ ID NO: 34377 - DNA, 17 bp, Homo sapiens
ttcacagggacgctcat

SEQ ID NO: 34378 - DNA, 17 bp, Homo sapiens
ttcacagggacgctcac

SEQ ID NO: 34379 - DNA, 24 bp, Homo sapiens
ggttaattctggatctcaagtatg

SEQ ID NO: 34380 - DNA, 25 bp, Homo sapiens
ctaatgctctgatgttgctactaac

SEQ ID NO: 34381 - DNA, 25 bp, Homo sapiens
ctaatgctctgatgttgctactaat

SEQ ID NO: 34382 - DNA, 23 bp, Homo sapiens
cgagaaaaggctgagttttatag

SEQ ID NO: 34383 - DNA, 18 bp, Homo sapiens
cctgattgggggaacaac

SEQ ID NO: 34384 - DNA, 18 bp, Homo sapiens
cctgattgggggaacaat

SEQ ID NO: 34385 - DNA, 24 bp, Homo sapiens
catctgcaaccctcttagatatac

SEQ ID NO: 34386 - DNA, 20 bp, Homo sapiens
tcgaagtcctaagctcaagt

SEQ ID NO: 34387 - DNA, 19 bp, Homo sapiens
cgaagtcctaagctcaagc

SEQ ID NO: 34388 - DNA, 24 bp, Homo sapiens
gggaccacaggttgctgaaattta

SEQ ID NO: 34389 - DNA, 18 bp, Homo sapiens
gccgtgataaacctctgt

SEQ ID NO: 34390 - DNA, 17 bp, Homo sapiens
ccgtgataaacctctgc

SEQ ID NO: 34391 - DNA, 21 bp, Homo sapiens
tttgattggcaatgtttacaa

SEQ ID NO: 34392 - DNA, 23 bp, Homo sapiens
gatagaggagttagagcacttgg

SEQ ID NO: 34393 - DNA, 24 bp, Homo sapiens
agatagaggagttagagcacttga

SEQ ID NO: 34394 - DNA, 23 bp, Homo sapiens
ctcgaagctgaagaagagataac

SEQ ID NO: 34395 - DNA, 18 bp, Homo sapiens
tgaagaacaccattgcca

SEQ ID NO: 34396 - DNA, 17 bp, Homo sapiens
gaagaacaccattgccg

SEQ ID NO: 34397 - DNA, 22 bp, Homo sapiens
gtgggagaggaaagacagtaat

SEQ ID NO: 34398 - DNA, 24 bp, Homo sapiens
aaaagtaataaccaccaatttcat

SEQ ID NO: 34399 - DNA, 24 bp, Homo sapiens
aaaagtaataaccaccaatttcac

SEQ ID NO: 34400 - DNA, 18 bp, Homo sapiens
caccttccccgttgacta

SEQ ID NO: 34401 - DNA, 20 bp, Homo sapiens
cctggagtacagcttgaggt

SEQ ID NO: 34402 - DNA, 19 bp, Homo sapiens
ctggagtacagcttgaggg

SEQ ID NO: 34403 - DNA, 18 bp, Homo sapiens
ccaggtctcggacactga

SEQ ID NO: 34404 - DNA, 25 bp, Homo sapiens
ccatttgaggtatgtttttaaaagt

SEQ ID NO: 34405 - DNA, 24 bp, Homo sapiens
catttgaggtatgtttttaaaagg

SEQ ID NO: 34406 - DNA, 20 bp, Homo sapiens
gctgcctgctgtcttttaac

SEQ ID NO: 34407 - DNA, 21 bp, Homo sapiens
tgagaaagagaagagtgccat

SEQ ID NO: 34408 - DNA, 21 bp, Homo sapiens
tgagaaagagaagagtgccac

SEQ ID NO: 34409 - DNA, 20 bp, Homo sapiens
cttccaccttccagcttact

SEQ ID NO: 34410 - DNA, 19 bp, Homo sapiens
ccggaaagacttctctcca

SEQ ID NO: 34411 - DNA, 18 bp, Homo sapiens
cggaaagacttctctccg

SEQ ID NO: 34412 - DNA, 25 bp, Homo sapiens
ttgtatctggtgaatctgaactaag

SEQ ID NO: 34413 - DNA, 22 bp, Homo sapiens
cagaagttagctgaggtcataa

SEQ ID NO: 34414 - DNA, 22 bp, Homo sapiens
cagaagttagctgaggtcatac

SEQ ID NO: 34415 - DNA, 24 bp, Homo sapiens
gcctggccaaattaatttctttct

SEQ ID NO: 34416 - DNA, 22 bp, Homo sapiens
gcttacttacgtggaaagactc

SEQ ID NO: 34417 - DNA, 22 bp, Homo sapiens
gcttacttacgtggaaagactg

SEQ ID NO: 34418 - DNA, 22 bp, Homo sapiens
tcttctgatggttgctctactc

SEQ ID NO: 34419 - DNA, 17 bp, Homo sapiens
ttcagaaagaggcgtcg

SEQ ID NO: 34420 - DNA, 20 bp, Homo sapiens
agattcagaaagaggcgtct

SEQ ID NO: 34421 - DNA, 17 bp, Homo sapiens
ggccgaaagctgttcac

SEQ ID NO: 34422 - DNA, 17 bp, Homo sapiens
tcccagacctcagccta

SEQ ID NO: 34423 - DNA, 16 bp, Homo sapiens
cccagacctcagcctg

SEQ ID NO: 34424 - DNA, 21 bp, Homo sapiens
tgtggccactcaggttcatat

SEQ ID NO: 34425 - DNA, 23 bp, Homo sapiens
agatgttacaacttgatcagtcg

SEQ ID NO: 34426 - DNA, 24 bp, Homo sapiens
cagatgttacaacttgatcagtca

SEQ ID NO: 34427 - DNA, 18 bp, Homo sapiens
cggcaggatggttctgta

SEQ ID NO: 34428 - DNA, 16 bp, Homo sapiens
gcatgggatggaggag

SEQ ID NO: 34429 - DNA, 16 bp, Homo sapiens
gcatgggatggaggat

SEQ ID NO: 34430 - DNA, 20 bp, Homo sapiens
gcgatggatggtctgagtta

SEQ ID NO: 34431 - DNA, 20 bp, Homo sapiens
gctacaaatgctcacaccag

SEQ ID NO: 34432 - DNA, 20 bp, Homo sapiens
gctacaaatgctcacaccaa

SEQ ID NO: 34433 - DNA, 25 bp, Homo sapiens
gccagaattttgttaatttcatact

SEQ ID NO: 34434 - DNA, 20 bp, Homo sapiens
tggtatgttcctgcttcatc

SEQ ID NO: 34435 - DNA, 20 bp, Homo sapiens
tggtatgttcctgcttcatg

SEQ ID NO: 34436 - DNA, 19 bp, Homo sapiens
caggcaggagatgtgtgag

SEQ ID NO: 34437 - DNA, 18 bp, Homo sapiens
tggtcgaagacagaggtg

SEQ ID NO: 34438 - DNA, 19 bp, Homo sapiens
ttggtcgaagacagaggtt

SEQ ID NO: 34439 - DNA, 24 bp, Homo sapiens
gttttcacattcaaggttttactc

SEQ ID NO: 34440 - DNA, 19 bp, Homo sapiens
caacaggcccaaatacttc

SEQ ID NO: 34441 - DNA, 19 bp, Homo sapiens
caacaggcccaaatacttt

SEQ ID NO: 34442 - DNA, 22 bp, Homo sapiens
cgtggtaaacaatgcagtaact

SEQ ID NO: 34443 - DNA, 20 bp, Homo sapiens
tctgcatctcatgcatcaga

SEQ ID NO: 34444 - DNA, 19 bp, Homo sapiens
ctgcatctcatgcatcagg

SEQ ID NO: 34445 - DNA, 24 bp, Homo sapiens
ggactagacccaggatttagttgt

SEQ ID NO: 34446 - DNA, 16 bp, Homo sapiens
gggatggtgagcaacg

SEQ ID NO: 34447 - DNA, 17 bp, Homo sapiens
agggatggtgagcaaca

SEQ ID NO: 34448 - DNA, 25 bp, Homo sapiens
gaacttgaggcttgcaaaggttaag

SEQ ID NO: 34449 - DNA, 14 bp, Homo sapiens
gaaccccgcgtgtg

SEQ ID NO: 34450 - DNA, 14 bp, Homo sapiens
gaaccccgcgtgtt

SEQ ID NO: 34451 - DNA, 20 bp, Homo sapiens
ccagtggtcctgtctctgta

SEQ ID NO: 34452 - DNA, 22 bp, Homo sapiens
ggggaattagtcatagggtatc

SEQ ID NO: 34453 - DNA, 22 bp, Homo sapiens
ggggaattagtcatagggtatt

SEQ ID NO: 34454 - DNA, 25 bp, Homo sapiens
gcttacccagactttaaaaatacac

SEQ ID NO: 34455 - DNA, 25 bp, Homo sapiens
atttaaactgttaattcataccacc

SEQ ID NO: 34456 - DNA, 26 bp, Homo sapiens
aatttaaactgttaattcataccaca

SEQ ID NO: 34457 - DNA, 20 bp, Homo sapiens
tttgctccaacctcatacag

SEQ ID NO: 34458 - DNA, 16 bp, Homo sapiens
gtggcatgggttggtt

SEQ ID NO: 34459 - DNA, 17 bp, Homo sapiens
tgtggcatgggttggta

SEQ ID NO: 34460 - DNA, 21 bp, Homo sapiens
gagatacaggccaaggagaat
